United States Patent 12,508,308 (INFLUENZA mRNA VACCINES) - sequence listing, part 17

SEQ ID NO: 61282 - RNA, 1701 nt, Artificial Sequence
  derived and/or modified sequence opt1 from hemagglutinin__InfluenzaA__AAZ79571
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccggugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgggugaccguguccaccaagcgcagccagcagaccgucaucccgaacaucgggucccggcccugggugcgcggcgugagcucccggaucagcaucuacuggacgaucgucaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacagcgaggggaccggccaggccgcggaccugaaguccacgcaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 61283 - RNA, 1701 nt, Artificial Sequence
  derived and/or modified sequence opt1 from hemagglutinin__InfluenzaA__AAZ79582
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucggguccggccccugggugcgcggcgugagcucccggaucagcaucuacuggacgaucgucaagcccggggacauccuccugaucaacuccaccggcaaccugaucgcgccccgcggguacuucaagauccggagcggcaaguccagcaucaugcgcuccgacgccccgaucggcaagugcaacagcgagugcaucacccccaacggguccauccccaacgacaagcccuuccagaacgugaaccggaucaccuacggcgccugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacagcgagggcaccgggcaggccgcggaccugaaguccacgcaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggcuucaucaugugggccugccagaaggggaacauccgcugcaacaucugcaucuga

SEQ ID NO: 61284 - RNA, 1698 nt, Artificial Sequence
  derived and/or modified sequence opt1 from hemagglutinin__InfluenzaA__AAZ79604
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaaccgcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 61285 - RNA, 1701 nt, Artificial Sequence
  derived and/or modified sequence opt1 from hemagglutinin__InfluenzaA__AAZ79615
augaagaccaucaucgcccugagcuacauccucugccugguguucgcccagaagauccccggcaacgacaacuccaccgcgacgcugugcgucgggcaccacgccgugccgaacggcaccaucgugaagaccaucaccaacgaccagaucgaggucacgaacgccaccgagcucgugcagagcuccagcaccgggggcaucugcgacagcccccaccagauccuggacggggagaacugcacccugaucgacgcccuccugggcgacccccagugcgacggcuuccagaacaagaagugggaccuguucguggagcgcagcaaggccuacuccaacugcuaccccuacgacgucccggacuacgcgagccuccggucccugguggccagcuccgggacgcuggaguucaacaacgagagcuucaacuggaccggcgugacccagaacgggaccuccagcgccugcaagcgccgguccaacaacagcuucuucucccgccucaacuggcugacgcaccugaaguucaaguaccccgcccucaacgucaccaugcccaacaacgagaaguucgacaagcuguacaucuggggcgugcaccaccccgggaccgacaacgaccagaucagccuguacgcgcaggccuccggccggaucaccgugagcacgaagcgcagccagcagaccgucaucccgaacaucggcucccggccccgcgugcgggacauccccagccgcaucuccaucuacuggaccaucgugaagcccggggacauccuccugaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccucaagcuggcgaccgggaugcgcaacgugcccgagaagcagacgcggggcaucuucggggccaucgccggcuucaucgagaacggcugggaggggauggucgacggcugguacggguuccgccaccagaacuccgagggcaucgggcaggccgccgaccugaaguccacccaggcggccaucaaccagaucaacggcaagcucaaccggcugaucggcaagaccaacgagaaguuccaccagaucgagaaggaguucuccgagguggaggggcgcauccaggaccuggagaaguacguggaggacaccaagaucgaccucuggagcuacaacgccgagcugcuggucgcccucgagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 61286 - RNA, 1701 nt, Artificial Sequence
  derived and/or modified sequence opt1 from hemagglutinin__InfluenzaA__AAZ79627
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacagcuccuucuucagccgccugaacuggcucacgcaccugaaguucaaguaccccgcccugaaggugaccaugcccaacaacgagaaguucgacaagcucuacaucuggggcguccaccaccccgggaccgacaacgaccagaucucccuguacgcgcaggccagcggccggaucaccgugagcacgaagcgcucccagcagaccgugaucccgaacaucggcagccggccccgcguccgggacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 61287 - RNA, 1701 nt, Artificial Sequence; identical to SEQ ID NO: 61264
  derived and/or modified sequence opt1 from hemagglutinin__InfluenzaA__AAZ79941

SEQ ID NO: 61288 - RNA, 1701 nt, Artificial Sequence; identical to SEQ ID NO: 61263
  derived and/or modified sequence opt1 from hemagglutinin__InfluenzaA__AAZ79944

SEQ ID NO: 61289 - RNA, 1701 nt, Artificial Sequence
  derived and/or modified sequence opt1 from hemagglutinin__InfluenzaA__AAZ79963
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccguccaucggcagccggccccgcauccgggacguccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 61290 - RNA, 1701 nt, Artificial Sequence
  derived and/or modified sequence opt1 from hemagglutinin__InfluenzaA__AAZ79974
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccaacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61291 - RNA, 1701 nt, Artificial Sequence; identical to SEQ ID NO: 61263
  derived and/or modified sequence opt1 from hemagglutinin__InfluenzaA__AAZ79996

SEQ ID NO: 61292 - RNA, 1701 nt, Artificial Sequence
  derived and/or modified sequence opt1 from hemagglutinin__InfluenzaA__AAZ80007
augaagaccaucaucgcccugagccacaucuucugccucgugcugggccaguaccugcccgggaacgacaacuccaccgccacgcucugccugggccaccacgcggucccgaacgggacccuggugaagaccaucaccaacgaccagaucgaggugacgaacgccaccgagcucguccagagcuccagcaccggcaagaucugcaacaacccccaccgcauccuggacgggaucgacugcacccugaucgacgcccuccugggcgacccccacugcgacggcuuccagaacgagacgugggaccuguucguggagcgguccaaggccuucagcaacugcuaccccuacgacgugccggacuacgccucccuccgcagccuggucgcguccagcgggacccuggaguucaucaccgagggcuucaccuggacgggggugacccagaacggcggguccaacgccugcaagcggggccccggcagcggguucuucucccgccucaacuggcugaccaagagcgaguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgccccgcggggguacuucaagaugcgcaccggcaaguccagcaucaugcgguccgacgcgcccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgccggguucaucgagaacggcugggaggggaugaucgacggcugguacggcuuccgccaccagaacagcgaggggaccggccaggcggccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagagcggcuacaaggacuggauccuguggaucuccuucgccaucagcugcuuccugcugugcguggugcugcucggguucaucaugugggcgugccagcgcggcaacauccggugcaacaucugcaucuga

SEQ ID NO: 61293 - RNA, 1701 nt, Artificial Sequence; identical to SEQ ID NO: 61264
  derived and/or modified sequence opt1 from hemagglutinin__InfluenzaA__AAZ80017

SEQ ID NO: 61294 - RNA, 1701 nt, Artificial Sequence
  derived and/or modified sequence opt1 from hemagglutinin__InfluenzaA__AAZ80030
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaccagccuguacgcgcaggccuccggccggaucacggugagcaccaagcgcagccagcagaccgugaucccgaacaucggcucccggccccgcguccgggacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgugaaccgcaucaccuacggcgccugcccccgguacgucaagcagaacacccugaagcucgcgacggggaugcgcaacgugcccgagaagcagacccggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61295 - RNA, 1701 nt, Artificial Sequence
  derived and/or modified sequence opt1 from hemagglutinin__InfluenzaA__AAZ83242
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcaacaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucaaccuguacgcgcaggccagcgggcggaucaccguguccacgaagcgcagccagcagaccgugaucccgaacaucggcuaccggccccgcguccgggacgugcccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 61296 - RNA, 1701 nt, Artificial Sequence
  derived and/or modified sequence opt1 from hemagglutinin__InfluenzaA__AAZ83266
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaacgagcucguccagagcuccagcaccgggcgcaucugcgacagcccccaccagauccuggacggcgagaacugcacccugaucgacgcccuccugggggacccccggugcgacggcuuccagaacaaggagugggaccuguucguggagcgcagcaaggccuacuccaacugcuaccccuacgacgugccggacuacgcgagccuccggucccuggucgccagcuccggcacccuggaguucaacaacgagagcuucaacuggacggggguggcccagaacggcaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcaccgacuccgaccagaucagccuguacgcccaggccagcgggcgggugacgguguccaccaagcgcagccagcagaccgucaucccgaacaucgggucccggcccugggugcgcggcgugagcucccggaucagcaucuacuggaccaucgucaagcccggcgacauccuccugaucaacuccacggggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucaccuacggggccugcccgcgcuacgugaagcagaacacccucaagcuggccacgggcaugcggaacguccccgagaagcagacccgcgggaucuucggcgccaucgccggguucaucgagaacggcugggagggcaugguggacgggugguacggcuuccggcaccagaacagcgaggggaccggccaggccgcggaccugaaguccacccaggccgccaucaaccagaucaacgggaagcucaaccgccugaucgagaagacgaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugaccgacagcgagaugaacaagcuguucgagcgcacgaagaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 61297 - RNA, 1701 nt, Artificial Sequence; identical to SEQ ID NO: 61194
  derived and/or modified sequence opt1 from hemagglutinin__InfluenzaA__AAZ83277

SEQ ID NO: 61298 - RNA, 1701 nt, Artificial Sequence; identical to SEQ ID NO: 61080
  derived and/or modified sequence opt1 from hemagglutinin__InfluenzaA__AAZ83288

SEQ ID NO: 61299 - RNA, 1701 nt, Artificial Sequence
  derived and/or modified sequence opt1 from hemagglutinin__InfluenzaA__AAZ83312
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaucaagagcuucuucucccggcucaacuggcugcaccagcugaaguacaaguaccccgcgcucaacgugaccaugcccaacaacgacaaguucgacaagcuguacaucuggggcguccaccaccccagcacggacuccgaccagaccagccuguacgcccaggccagcgggcgcgugaccguguccaccaagcggagccagcagacggucaucccgaacaucgggucccgccccugggugcggggcgugagcucccgcaucagcaucuacuggaccaucgucaagcccggcgacauccuccugaucaacuccaccgggaaccugaucgcgccccggggcuacuucaagauccgcagcgggaaguccagcaucauccgguccgacgccccgaucggcaagugcaacagcgagugcaucacccccaacggcuccauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacagcgaggggacgggccaggccgcggaccugaaguccacccaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 61300 - RNA, 1701 nt, Artificial Sequence
  derived and/or modified sequence opt1 from hemagglutinin__InfluenzaA__AAZ83323
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugcaggacuacgcgagccuccggucccuggucgccagcuccggcacgcuggaguucaacaacgagagcuucaacuggaccgggguggcccagaacggcaccuccuacgccugcaagcgccggagcaucaaguccuucuucagccgccucaacuggcugcaccagcugaaguacaaguacccggcgcucaacgugaccaugcccaacaacgacaaguucgacaagcuguacaucuggggcguccaccaccccuccacggacagcgaccagaccucccuguacgcccaggccagcgggcgggugaccgugagcaccaagcgcucccagcagacggucaucagcaacaucgggucccggcccugggugcgcggcgugagcucccggaucagcaucuacuggaccaucgucaagccgggcgacauccuccugaucaccuccaccgggaaccugaucgcgccccgcggcuacuucaagauccggagcgggaaguccagcaucaugcgcuccgacgcccccaucggcaagugcaacagcgagugcaucacgcccaacggcuccaucccgaacgacaagcccuuccagaacgugaaccggaucaccuacggggccugcccccgcuacgugaagcagaacacccucaagcuggccaccggcaugcggaacguccccgagaagcagacgcgcgggaucuucggcgccaucgccggguucaucgagaacggcugggagggcaugguggacgggugguacggcuuccggcaccagaacagcgaggggaccggccaggccgcggaccugaaguccacccaggccgccaucaaccagaucaacgggaagcucaaccgccugaucgagaagaccaacgagaaguuccaccagaucgagaaggaguucagcgagguggagggccggauccaggaccuggagaaguacgucgaggacacgaagaucgaccucugguccuacaacgccgagcugcugguggcccucgagaaccagcacaccaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggacguacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 61301 - RNA, 1701 nt, Artificial Sequence; identical to SEQ ID NO: 61290
  derived and/or modified sequence opt1 from hemagglutinin__InfluenzaA__AAZ83371

SEQ ID NO: 61302 - RNA, 1701 nt, Artificial Sequence; identical to SEQ ID NO: 61263
  derived and/or modified sequence opt1 from hemagglutinin__InfluenzaA__AAZ83688

SEQ ID NO: 61303 - RNA, 1698 nt, Artificial Sequence
  derived and/or modified sequence opt1 from hemagglutinin__InfluenzaA__ABA06510
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucgccaaggagagcugguccuacaucgucgagacccccaaccccgagaacggcgccugcuaccccggcuacuucgccgacuacgaggagcugcgcgagcagcucagcuccgugagcuccuucgagcgguucgagaucuucccgaaggagagcuccuggcccaaccacacggugaccggggucagcgccuccugcagccacaacggcaaguccagcuucuaccgcaaccugcuguggcucaccgggaagaacggccuguaccccaaccuguccaagagcuacgccaacaacaaggagaaggaggugcucauccuguggggcgugcaccacccgcccaacaucggggaccagcggacccuguaccacacggagaacgccuacgucuccguggugagcagccacuacucccgccgguucacccccgagaucaccaagcgccccaagguccgggaccaggagggccgcaucaacuacuacuggacccuccuggagcccggggacacgaucaucuucgaggcgaacggcaaccugaucgccccgugguacgccuucgcccucagccggggguucggcuccggcaucaucaccagcaacgcccccauggacgagugcgacgcgaagugccagacgccccagggggccaucaacuccagccugcccuuccagaacgugcacccggugaccaucggcgagugccccaaguacguccgcuccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgucaagaaccuguacgagaaggucaagagccagcugaagaacaacgcgaaggagaucgggaacggcugcuucgaguucuaccacaagugcaacaacgagugcauggaguccgugaagaacgggacguacgacuaccccaaguacagcgaggaguccaagcucaaccgggagaagaucgacggcgugaagcuggacagcaugggcguguaccagauccuggccaucuacuccaccguggccagcagccucguccugcuggugucccucggggccaucagcuucuggaugugcuccaacggcagccugcagugccgcaucugcaucuga

SEQ ID NO: 61304 - RNA, 1698 nt, Artificial Sequence
  derived and/or modified sequence opt1 from hemagglutinin__InfluenzaA__ABA08464
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 61305 - RNA, 1698 nt, Artificial Sequence; identical to SEQ ID NO: 61304
  derived and/or modified sequence opt1 from hemagglutinin__InfluenzaA__ABA08486

SEQ ID NO: 61306 - RNA, 1698 nt, Artificial Sequence
  derived and/or modified sequence opt1 from hemagglutinin__InfluenzaA__ABA08508
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaagaagaaggaggugcucauccuguggggcgugcaccacccgcccaacaucgggguccagcggacccuguacuacacggagaacgccuacgugagcguggucagcucccacuacagccgccgguucacccccgagaucaccaagcgccccaaggugcgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggucaccaucggcgagugccccaaguacgugcgcagcgccaagcugcggauggugaccgggcuccgcaacauccccuccauccagagccggggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcgccggauggagaaccucaacaagaagguggacgacggcuuccuggacaucuggaccuacaacgccgagcugcucguccugcuggagaacgagcgcacccucgacuuccacgacagcaacgugaagaaccuguacgagaaggugaagucccagcugaagaacaacgccaaggagaucgggaacggcugcuucgaguucuaccacaagugcaacaacgagugcauggagagcgucaagaacgggacguacgacuaccccaaguacuccgaggagagcaagcucaaccgggagaagaucgacggcgugaagcuggacuccaugggcguguaccagauccuggcgaucuacagcaccgucgccagcucccucgugcugcuggugagccucggggccaucuccuucuggaugugcagcaacggcucccugcagugccgcaucugcaucuga

SEQ ID NO: 61307 - RNA, 1698 nt, Artificial Sequence
  derived and/or modified sequence opt1 from hemagglutinin__InfluenzaA__ABA12707
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 61308 - RNA, 1698 nt, Artificial Sequence
  derived and/or modified sequence opt1 from hemagglutinin__InfluenzaA__ABA12715
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcaccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgccgcggaccagaaguccacccagaacgccaucaacgggaucaccaacaaggugaacagcgucaucgagaagaugaacacgcaguucaccgccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucggcaacgggugcuucgaguucuaccacaagugcgacaacgagugcauggagagcgugaagaacggcacguacgacuaccccaaguacuccgaggagagcaagcucaaccgggagaagaucgacggcgugaagcuggaguccaugggggucuaccagauccuggcgaucuacagcaccguggccagcucccucguguuccuggucagccugggcgccaucuccuucuggaugugcagcaacgggucccuccagugccgcaucugcaucuga

SEQ ID NO: 61309 - RNA, 1698 nt, Artificial Sequence
  derived and/or modified sequence opt1 from hemagglutinin__InfluenzaA__ABA12729
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacaucagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacccagaacgccaucaacggcaucaccaacaaggugaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacgacgagugcauggagagcgucaagaacgggaccuacgacuacccccgcuacuccgaggagagcaagcucaaccgggagaagaucgacggcgugaagcuggaguccaugggcguguaccagauccuggccaucuacagcacggucgccagcucccucgugcugcuggugagccucggggccaucuccuucuggaugugcagcaacggcucccugcagugccgcaucugcaucuga

SEQ ID NO: 61310 - RNA, 1701 nt, Artificial Sequence; identical to SEQ ID NO: 61294
  derived and/or modified sequence opt1 from hemagglutinin__InfluenzaA__ABA12740

SEQ ID NO: 61311 - RNA, 1701 nt, Artificial Sequence; identical to SEQ ID NO: 61263
  derived and/or modified sequence opt1 from hemagglutinin__InfluenzaA__ABA12751

SEQ ID NO: 61312 - RNA, 1701 nt, Artificial Sequence
  derived and/or modified sequence opt1 from hemagglutinin__InfluenzaA__ABA12762
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccuggucgccagcuccgggacgcucgaguucaacaacgagagcuucaacuggaccggcgugacccagaacgggaccuccagcgccugcaagcgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccgacaacgaccagaucagccucuacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcugaucaacagcaccggcaaccucaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcgugguccugcugggguucaucaugugggccugccagaagggcaacauccggugcaacaucugcaucuga

SEQ ID NO: 61313 - RNA, 1701 nt, Artificial Sequence
  derived and/or modified sequence opt1 from hemagglutinin__InfluenzaA__ABA12773
augaagaccaucaucgcccugagcuacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccagcaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccagcgggacccuggaguucaucaacgagggcuucaccuggaccggggugacgcagaacggcggguccaacgccugcaagcggggccccgacagcggcuucuucucccgccugaacuggcucuacaagagcggguccaccuaccccgugcugaacgucaccaugcccaacaacgacaacuucgacaagcuguacaucuggggcgugcaccacccgagcaccgaccaggagcagacgucccucuacgugcaggccagcgggcgggucaccguguccaccaagcgcagccagcagaccaucauccccaacaucggcagccggcccugggugcgcggccuguccagccggaucuccaucuacuggacgaucgucaagcccggggacauccuggugaucaacagcaacggcaaccucaucgccccgcgcggguacuucaagaugcggaccggcaaguccagcaucaugcgcuccgacgcgcccaucgggaccugcaucagcgagugcaucacccccaacggcuccauccccaacgacaagccguuccagaacgugaacaagaucacguacggcgccugccccaaguacgucaagcagaacacccugaagcuggccaccgggaugcggaacgugcccgagaagcagacccgcggccucuucggggccaucgccggcuucaucgagaacgggugggagggcaugaucgacggcugguacggguuccggcaccagaacagcgagggcacggggcaggcggccgaccugaaguccacccaggccgccaucgaccagaucaacggcaagcugaaccgcgugaucgagaagaccaacgagaaguuccaccagaucgagaaggaguucagcgaggucgaggggcggauccaggaccucgagaaguacguggaggacaccaagaucgaccugugguccuacaacgccgagcugcucguggcgcuggagaaccagcacacgaucgaccugaccgacagcgagaugaacaagcuguucgagaagacccgccggcagcuccgcgagaacgccgaggacaugggcaacggcugcuucaagaucuaccacaagugcgacaacgccugcaucggguccauccggaacggcaccuacgaccacgacgucuaccgcgacgaggcccugaacaaccgcuuccagaucaaggggguggagcucaagagcggcuacaaggacuggauccuguggaucuccuucgccaucagcugcuuccugcucugcgucgugcugcugggcuucaucaugugggcgugccagaaggggaacauccggugcaacaucugcaucuga

SEQ ID NO: 61314 - RNA, 1701 nt, Artificial Sequence
  derived and/or modified sequence opt1 from hemagglutinin__InfluenzaA__ABA12780
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccaacaacgaccagaucagccuguacgcgcaggccuccggccggaucaccgugagcacgaagcgcagccagcagaccgugaucccgaacaucgagucccggccccgcguccgggacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 61315 - RNA, 1701 nt, Artificial Sequence
  derived and/or modified sequence opt1 from hemagglutinin__InfluenzaA__ABA16214
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucagcaacugcuaccccuacgacgugccggacuacgcgucccugcggagccucgucgccuccagcggcacgcuggaguucaucaacgagggguucaacuggaccggcgugacccaguccgggggcagcuacgccugcaagcgcggguccgucaagagcuucuucucccggcugaacuggcucuacgagagcgaguccaaguaccccgcccugaacgugaccaugcccaacaacggcaaguucgacaagcuguacaucuggggcgugcaccaccccagcacggacaaggagcagaccaaccucuacgugcgcgcgagcgggcgggucaccguguccaccaagcgcagccagcagacggugaucccgaacaucggcccccggcccuggguccgcgggcuguccagccggaucuccaucuacuggaccaucgugaagcccggcgacauccugcucaucaacagcaccggcaaccugaucgccccgcgcggguacuucaagauccggaccggcaaguccagcaucaugcgcuccgacgcccccaucgggacgugcagcuccggcugcaucacccccaacgggagcauccccaacgacaagccguuccagaacgugaacaagaucaccuacggcgccugcccccgguacgucaagcagaacacccugaagcucgccacgggcaugcgcaacgugcccgagaagcagacccgggggaucuucggcgcgaucgccggguucaucgagaacggcugggaggggaugguggacggcugguacggcuuccgccaccagaacuccgaggggaccggccaggccgccgaccucaagagcacccaggccgcgaucgaccagaucaacgggaagcugaaccggcucaucgagaagacgaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgacaugaccgacuccgagaugaacaagcuguucgagaagacgcggaagcagcugcgcgagaacgccgaggacauggggaacggcugcuucaagaucuaccacaagugcgacaacgccugcaucggcagcauccgcaacgggaccuacgaccacgacgucuaccgggacgaggcgcugaacaaccgcuuccagaucaagggcguggagcucaaguccggguacaaggacuggauccuguggaucagcuucgccaucagcugcuuccugcucugcgucgugcugcugggcuucaucaugugggccugccagaagggcaacauccggugcaacaucugcaucuga

SEQ ID NO: 61316 - RNA, 1701 nt, Artificial Sequence; identical to SEQ ID NO: 61264
  derived and/or modified sequence opt1 from hemagglutinin__InfluenzaA__ABA18026

SEQ ID NO: 61317 - RNA, 1698 nt, Artificial Sequence
  derived and/or modified sequence opt1 from hemagglutinin__InfluenzaA__ABA18037
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugaaggagcagcucuccagcguguccagcuucgagcgcuucgagaucuucccgaagggguccagcuggcccaaccacaccgugaccggcgucuccgccagcugcucccacaacggcaagagcuccuucuaccggaaccugcuguggcucaccgggaagaacgggcuguaccccaaccugagcauguccuacgugaacaacaaggagaaggaggugcucguccuguggggcgugcaccacccgcccaacaucggcgaccagcgcgcccuguaccacacggagaacgccuacgugagcgucgugagcucccacuacagccggcgcuucacccccgagaucgccaagcggcccaaggugcgcgaccaggaggggcggaucaacuacuacuggacccuccuggagcccggcgacaccaucaucuucgaggcgaacgggaaccugaucgccccgugguacgccuucgcccucucccgcggcuucggcagcgggaucaucacguccaacgcccccauggacgagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 61318 - RNA, 1701 nt, Artificial Sequence; identical to SEQ ID NO: 61263
  derived and/or modified sequence opt1 from hemagglutinin__InfluenzaA__ABA18048

SEQ ID NO: 61319 - RNA, 1701 nt, Artificial Sequence
  derived and/or modified sequence opt1 from hemagglutinin__InfluenzaA__ABA18123
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagcggccccugggugcgcggggucuccagccggaucuccaucuacuggacgaucgugaagcccggcgacauccuccugaucaacagcaccgggaaccugaucgcgccccgcggcuacuucaagauccgguccggcaagagcuccaucaugcgcagcgacgccccgaucgggaagugcaacuccgagugcaucacccccaacggcagcauccccaacgacaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggaccggccaggccgccgaccugaaguccacgcaggcggccaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacaugggcaacgggugcuucaagaucuaccacaagugcgacaacgcgugcaucggcagcauccgcaacgggaccuacgaccacgacguguaccgcgacgaggcccugaacaaccgguuccagaucaagggcgucgagcugaaguccggcuacaaggacuggauccucuggaucagcuucgccaucagcugcuuccugcugugcaucgugcuccugggguucaucaugugggccugccagaagggcaacauccgcugcaacaucugcaucuga

SEQ ID NO: 61320 - RNA, 1701 nt, Artificial Sequence; identical to SEQ ID NO: 61263
  derived and/or modified sequence opt1 from hemagglutinin__InfluenzaA__ABA18134

SEQ ID NO: 61321 - RNA, 1698 nt, Artificial Sequence; identical to SEQ ID NO: 61307
  derived and/or modified sequence opt1 from hemagglutinin__InfluenzaA__ABA18145

SEQ ID NO: 61322 - RNA, 1701 nt, Artificial Sequence; identical to SEQ ID NO: 61264
  derived and/or modified sequence opt1 from hemagglutinin__InfluenzaA__ABA18156

SEQ ID NO: 61323 - RNA, 1701 nt, Artificial Sequence
  derived and/or modified sequence opt1 from hemagglutinin__InfluenzaA__ABA26700
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcaacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccccgggccggaucaccguguccacgaagcgcagccagcagaccgugauccccaacaucggcagccggccccgcguccgggacauccccucccgcaucagcaucuacuggaccaucgugaagccgggggacauccugcucaucaacuccaccggcaaccugaucgcgccccggggguacuucaagauccgcagcggcaaguccagcaucaugcgguccgacgcccccaucggcaagugcaacagcgagugcaucacgcccaacggguccaucccgaacgacaagcccuuccagaacgugaaccgcaucaccuacggcgccugcccccgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 61324 - RNA, 1701 nt, Artificial Sequence
  derived and/or modified sequence opt1 from hemagglutinin__InfluenzaA__ABA26711
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaaguccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61325 - RNA, 1701 nt, Artificial Sequence
  derived and/or modified sequence opt1 from hemagglutinin__InfluenzaA__ABA26722
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcucccccaccgggggcaucugcgacagcccccaccagauccucgacggggagaacugcacccugaucgacgcccugcucggcgacccccagugcgacggcuuccagaacaagaagugggaccuguucguggagcgcuccaaggcccacagcaacugcuacccguacgacgugcccgacuacgcgucccugcggagccucgucgccuccagcgggacgcuggaguucaacaacgaguccuucaacuggaccggcgugacccagaacgggaccagcuccgccugcaagcgccggagcaacaaguccuucuucagccgccugaacuggcucacgcaccugaaguucaaguaccccgcccugaacgugaccaugcccaacaacgagaaguucgacaagcucuacaucuggggcguccaccacccggggaccgacaacgaccagaucucccuguacgcgcaggccagcggccggaucaccguguccacgaagcgcagccagcagaccgugauccccaacaucggcagccggccccgcguccgggacgugcccucccgcaucagcaucuacuggaccaucgugaagccgggggacauccugcucaucaacuccaccggcaaccugaucgcgccccggggguacuucaagauccgcagcggcaaguccagcaucaugcgguccgacgcccccaucggcaagugcaacagcgggugcaucacgcccaacggcuccaucccgaacgacaagcccuuccagaacgucaaccgcaucaccuacggggccugcccccgguacgugaagcagaacacccugaagcucgccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcugaaccggcucaucgggaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaagggcguggagcucaagagcggguacaaggacuggauccuguggaucuccuucgccaucagcugcuuccugcugugcgucgcccugcucggcuucaucaugugggccugccagaaggggaacauccggugcaacaucugcaucuga

SEQ ID NO: 61326 - RNA, 1701 nt, Artificial Sequence; identical to SEQ ID NO: 61251
  derived and/or modified sequence opt1 from hemagglutinin__InfluenzaA__ABA26733

SEQ ID NO: 61327 - RNA, 1701 nt, Artificial Sequence; identical to SEQ ID NO: 61251
  derived and/or modified sequence opt1 from hemagglutinin__InfluenzaA__ABA26755

SEQ ID NO: 61328 - RNA, 1701 nt, Artificial Sequence; identical to SEQ ID NO: 61290
  derived and/or modified sequence opt1 from hemagglutinin__InfluenzaA__ABA26766

SEQ ID NO: 61329 - RNA, 1701 nt, Artificial Sequence; identical to SEQ ID NO: 61290
  derived and/or modified sequence opt1 from hemagglutinin__InfluenzaA__ABA26788

SEQ ID NO: 61330 - RNA, 1701 nt, Artificial Sequence; identical to SEQ ID NO: 61290
  derived and/or modified sequence opt1 from hemagglutinin__InfluenzaA__ABA26799

SEQ ID NO: 61331 - RNA, 1698 nt, Artificial Sequence
  derived and/or modified sequence opt1 from hemagglutinin__InfluenzaA__ABA42247
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggggaccagcgcgcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61332 - RNA, 1698 nt, Artificial Sequence; identical to SEQ ID NO: 61304
  derived and/or modified sequence opt1 from hemagglutinin__InfluenzaA__ABA42258

SEQ ID NO: 61333 - RNA, 1701 nt, Artificial Sequence; identical to SEQ ID NO: 61263
  derived and/or modified sequence opt1 from hemagglutinin__InfluenzaA__ABA42269

SEQ ID NO: 61334 - RNA, 1698 nt, Artificial Sequence
  derived and/or modified sequence opt1 from hemagglutinin__InfluenzaA__ABA42280
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucagcguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagagcaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcaucugcaucuga

SEQ ID NO: 61335 - RNA, 1701 nt, Artificial Sequence
  derived and/or modified sequence opt1 from hemagglutinin__InfluenzaA__ABA42291
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaaguccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagacggaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61336 - RNA, 1701 nt, Artificial Sequence; identical to SEQ ID NO: 61059
  derived and/or modified sequence opt1 from hemagglutinin__InfluenzaA__ABA42302

SEQ ID NO: 61337 - RNA, 1701 nt, Artificial Sequence; identical to SEQ ID NO: 61113
  derived and/or modified sequence opt1 from hemagglutinin__InfluenzaA__ABA42313

SEQ ID NO: 61338 - RNA, 1701 nt, Artificial Sequence; identical to SEQ ID NO: 61059
  derived and/or modified sequence opt1 from hemagglutinin__InfluenzaA__ABA42346

SEQ ID NO: 61339 - RNA, 1701 nt, Artificial Sequence; identical to SEQ ID NO: 61113
  derived and/or modified sequence opt1 from hemagglutinin__InfluenzaA__ABA42357

SEQ ID NO: 61340 - RNA, 1701 nt, Artificial Sequence
  derived and/or modified sequence opt1 from hemagglutinin__InfluenzaA__ABA42379
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagcaagaucuccaucuacuggacgaucgugaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggccgcgaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgccugcaucgggagcauccgcaacggcaccuacgaccacgacguguaccgcgacgaggcgcugaacaaccgguuccagaucaagggggucgagcugaaguccggcuacaaggacuggauccucuggaucagcuucgccaucagcugcuucgugcugugcaucguccugcucggcuucaucaugugggccugccagaaggggaacauccgcugcaacaucugcaucuga

SEQ ID NO: 61341 - RNA, 1701 nt, Artificial Sequence; identical to SEQ ID NO: 61088
  derived and/or modified sequence opt1 from hemagglutinin__InfluenzaA__ABA42390

SEQ ID NO: 61342 - RNA, 1701 nt, Artificial Sequence
  derived and/or modified sequence opt1 from hemagglutinin__InfluenzaA__ABA42401
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcagagcuccggccgcgugaccgucagcaccaagcggucccagcagaccgugaucccgaacaucgggagcggccccugggugcgcggcgucuccagccggaucuccaucuacuggacgaucgugaagcccggggacauccuccugaucaacagcaccggcaaccugaucgcgccccgcggguacuucaagauccgguccggcaagagcuccaucaugcgcagcgacgccccgaucggcaagugcaacuccaagugcaucacccccaacgggagcauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccucaagagcacgcaggccgcgaucaaccagaucaacggcaagcugaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgccugcaucgggagcauccgcaacggcaccuacgaccacgacguguaccgcgacgaggcgcugaacaaccgguuccagaucaagggggucgagcucaagagcggcuacaaggacuggauccuguggaucuccuucgccaucagcugcuuccugcugugcaucgugcuccugggcuucaucaugugggccugccagaaggggaacauccgcugcaacaucugcaucuga

SEQ ID NO: 61343 - RNA, 1701 nt, Artificial Sequence
  derived and/or modified sequence opt1 from hemagglutinin__InfluenzaA__ABA42412
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagcaagaucuccaucuacuggacgaucgugaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccagcggguccauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacagcgagggcaccgggcaggccgccgaccugaaguccacgcaggccgcgaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgccgaggacauggggaacggcugcuucaagaucuaccacaagugcgacaacgccugcaucggguccauccgcaacggcaccuacgaccacgacguguaccgcgacgaggcgcugaacaaccgguuccagaucaagggggucgagcugaaguccggcuacaaggacuggauccucuggaucagcuucgccaucuccugcuuccugcugugcaucgugcuccugggcuucaucaugugggccugccagaaggggaacauccgcugcaacaucugcaucuga

SEQ ID NO: 61344 - RNA, 1701 nt, Artificial Sequence; identical to SEQ ID NO: 61055
  derived and/or modified sequence opt1 from hemagglutinin__InfluenzaA__ABA42443

SEQ ID NO: 61345 - RNA, 1701 nt, Artificial Sequence; identical to SEQ ID NO: 61059
  derived and/or modified sequence opt1 from hemagglutinin__InfluenzaA__ABA42454

SEQ ID NO: 61346 - RNA, 1701 nt, Artificial Sequence
  derived and/or modified sequence opt1 from hemagglutinin__InfluenzaA__ABA42465
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccagcggccgcgugaccgucuccaccaagcggagccagcagaccgugaucccgaacaucgggucccgccccuggggccggggcgugagcucccgcaucagcaucuacuggacgaucgucaagcccggggacauccuccugaucaacuccaccggcaaccugaucgcgccccggggguacuucaagauccgcagcggcaaguccagcaucaugcgguccgacgccccgaucggcaagugcaacagcgagugcaucacccccaacggguccauccccaacgacaagcccuuccagaacgugaaccgcaucaccuacggcgccugcccgcgguacgugaagcagaacacgcucaagcuggccaccgggaugcgcaacguccccgagaagcagacccggggcaucuucggggccaucgccggcuucaucgagaacggcugggaggggaugauggacggcugguacggguuccgccaccagaacagcgagggcaccgggcaggccgccgaccugaaguccacgcaggcggccaucaaccagaucaacggcaagcucaaccggcugaucgagaagaccaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaaggggguggagcucaagagcggcuacaaggacuggauccuguggaucagcuucgccaucuccugcuuccugcugugcaucguccuccugggcuucaucaugugggccugccagaaggggaacauccggugcaacaucugcaucuga

SEQ ID NO: 61347 - RNA, 1701 nt, Artificial Sequence
  derived and/or modified sequence opt1 from hemagglutinin__InfluenzaA__ABA42476
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccggaacgaggcgcugaacaaccgcuuccagaucaagggggucgagcugaaguccggcuacaaggacuggauccucuggaucagcuucgccaucagcugcuuccugcugugcaucgugcuccugggcuucaucaugugggccugccagaaggggaacauccggugcaacaucugcaucuga

SEQ ID NO: 61348 - RNA, 1701 nt, Artificial Sequence
  derived and/or modified sequence opt1 from hemagglutinin__InfluenzaA__ABA42498
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccagcggccgcgugaccgucuccaccaagcggagccagcagaccgugaucccgaacaucgggucccgccccugggugcggggcgucagcuccaucaucagcaucuacuggacgaucgugaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggguucaucgagaacggcugggagggcaugauggacgggugguacggcuuccggcaccagaacagcgaggggaccggccaggccgccgaccugaaguccacgcaggcggccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgccgaggacaugggcaacgggugcuucaagaucuaccacaagugcgacaacgcgugcaucggcuccauccgcaacgggaccuacgaccacgacguguaccgcgacgaggcccugaacaaccgguuccagaucaagggcgucgagcucaagagcggguacaaggacuggauccuguggaucagcuucgccaucuccugcuuccugcugugcaucgugcuccugggcuucaucaugugggccugccagaagggcaacauccgcugcaacaucugcaucuga

SEQ ID NO: 61349 - RNA, 1701 nt, Artificial Sequence; identical to SEQ ID NO: 61080
  derived and/or modified sequence opt1 from hemagglutinin__InfluenzaA__ABA42509

SEQ ID NO: 61350 - RNA, 1701 nt, Artificial Sequence
  derived and/or modified sequence opt1 from hemagglutinin__InfluenzaA__ABA42520
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgacuacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcuccaucaucagcaucuacuggaccaucgugaagcccggcgacauccuccugaucaacuccaccggcaaccugaucgcgccccggggguacuucaagauccggagcggcaaguccagcaucaugcgcuccaacgccccgaucgggaagugcaacagcgagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 61351 - RNA, 1701 nt, Artificial Sequence
  derived and/or modified sequence opt1 from hemagglutinin__InfluenzaA__ABA42531
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcgguccacggccuacuccaacugcuaccucuacgacguccccgacuacgcgagccugcgcucccugguggccagcuccggcacccucgaguucaacaacgagagcuucaacuggaccggcguggcccagaacgggaccuccagcgccugcaagcggcgcuccaucaagagcuucuucucccggcugaacuggcugcaccagcucaaguacaaguacccggcgcugaacgucacgaugcccaacaacgagaaguucgacaagcuguacaucuggggcgugcaccaccccagcaccgacuccgaccagaucagccucuacgcccaggccagcgggcgcgugaccgucuccaccaagcggagccagcagacggugauccccaacaucggcucccgcccgugggugcgcggggucagcucccggaucagcaucuacuggaccaucgugaagcccggcgacauccugcugaucaacuccaccggcaaccucaucgcgccccggggguacuucaagauccgcagcggcaaguccagcaucaugcgguccaacgcccccaucgggaagugcaacagcgagugcaucaccccgaacggcuccauccccaacgacaagcccuuccagaacgugaaccgcaucacguacggcgccugcccccgguacgucaagcagaacacccugaagcuggccaccgggaugcgcaacgugccggagaagcagacccggggcaucuucggggccaucgccggcuucaucgagaacgggugggagggcaugguggacggcugguacggguuccgccaccagaacagcgagggcacggggcaggccgcggaccucaaguccacccaggccgccaucaaccagaucaacggcaagcugaaccggcugaucgagaagaccaacgagaaguuccaccagaucgagaaggaguucagcgaggucgaggggcgcauccaggaccucgagaaguacguggaggacaccaagaucgaccugugguccuacaacgccgagcugcucguggcccuggagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcucaagagcggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 61352 - RNA, 1701 nt, Artificial Sequence; identical to SEQ ID NO: 61080
  derived and/or modified sequence opt1 from hemagglutinin__InfluenzaA__ABA42542

SEQ ID NO: 61353 - RNA, 1701 nt, Artificial Sequence
  derived and/or modified sequence opt1 from hemagglutinin__InfluenzaA__ABA42553
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggcccacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61354 - RNA, 1701 nt, Artificial Sequence; identical to SEQ ID NO: 61080
  derived and/or modified sequence opt1 from hemagglutinin__InfluenzaA__ABA42564

SEQ ID NO: 61355 - RNA, 1701 nt, Artificial Sequence
  derived and/or modified sequence opt1 from hemagglutinin__InfluenzaA__ABA42928
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcuccaagaucagcaucuacuggaccaucgugaagcccggcgacauccuccugaucaacuccaccggcaaccugaucgcgccccggggguacuucaagauccggagcggcaaguccagcaucaugcgcuccaacgccccgaucgggaagugcaacagcgagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcauggugaacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 61356 - RNA, 1701 nt, Artificial Sequence; identical to SEQ ID NO: 61080
  derived and/or modified sequence opt1 from hemagglutinin__InfluenzaA__ABA42939

SEQ ID NO: 61357 - RNA, 1701 nt, Artificial Sequence
  derived and/or modified sequence opt1 from hemagglutinin__InfluenzaA__ABA42978
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgauccccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61358 - RNA, 1701 nt, Artificial Sequence; identical to SEQ ID NO: 61251
  derived and/or modified sequence opt1 from hemagglutinin__InfluenzaA__ABA43167

SEQ ID NO: 61359 - RNA, 1701 nt, Artificial Sequence
  derived and/or modified sequence opt1 from hemagglutinin__InfluenzaA__ABA43178
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcaucgcccugcucggguucaucaugugggccugccagaagggcaacauccggugcaacaucugcaucuga

SEQ ID NO: 61360 - RNA, 1698 nt, Artificial Sequence
  derived and/or modified sequence opt1 from hemagglutinin__InfluenzaA__ABA43189
augaaggccaagcugcucgugcugcugugcaccuucaccgccacguacgcggacaccaucugcgucggcuaccacgccaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgucaccggcguguccgccagcugcucccacaacggcaagagcuccuucuaccgcaaccugcuguggcucaccgggaagaacgggcuguaccccaaccugagcauguccuacgugaacaacaaggagaaggagguccucgugcuguggggcgugcaccacccgcccaacaucggcgaccagcgggcccuguaccacacggagaacgccuacgucagcguggugagcucccacuacagccgccgguucacccccgagaucgccaagcgccccaagguccgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggucaacagcgugaucgagaagaugaacacccaguucacggccgucggcaaggaguucaacaagcuggagcgccggauggagaaccucaacaagaagguggacgacggguuccuggacaucuggaccuacaacgccgagcugcucgugcugcuggagaacgagcgcacccucgacuuccacgacagcaacgucaagaaccuguacgagaaggugaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgggagaagaucgacggcgucaagcuggaguccauggggguguaccagauccuggccaucuacagcacgguggccagcucccucguccugcuggugagccucggcgccaucuccuucuggaugugcagcaacgggucccugcagugccgcaucugcaucuga

SEQ ID NO: 61361 - RNA, 1701 nt, Artificial Sequence
  derived and/or modified sequence opt1 from hemagglutinin__InfluenzaA__ABA43200
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccuggugguccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcguggagcugaaguccggcuacaaggacuggauccuguggaucagcuucgccaucuccugcuuccuccugugcgucgugcugcucggguucaucaugugggccugccagaagggcaacauccggugcaacaucugcaucuga

SEQ ID NO: 61362 - RNA, 1701 nt, Artificial Sequence
  derived and/or modified sequence opt1 from hemagglutinin__InfluenzaA__ABA43336
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagaacagcuccaccgggcgcaucugcgacagcccccaccggauccucgacggcaagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaucaacgaggacuucaacuggaccgggguggcccaguccggcgggagcuacgccugcaagcgcggcuccgugaacagcuucuucucccggcugaacuggcuccacgagagcgaguacaaguaccccgcgcugaacgucaccaugcccaacaacgggaaguucgacaagcuguacguguggggcgugcaccaccccaucaccgaccgcgagcagacgaagcucuacguccgggccuccggccgcgugaccgugagcaccaagcggucccagcagaccgucaucccgaacaucgggagccgccccugggugcggggccugagcucccgcaucagcaucuacuggacgaucgugaagcccggggacauccugcucaucaacuccaccggcaaccugaucgcgccccggggcuacuucaagauccgcaccggcaagagcuccaucaugcggagcgacgccccgaucgggaccugcuccagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggcgccaucgccggguucaucgagaacggcugggaggggauggucgacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaagggcgucgagcucaagagcggguacaaggacuggauccuguggaucuccuucgccaucagcugcuuccugcugugcguggugcugcucggcuucaucaugugggccugccagaaggggaacauccggugcaacaucugcaucuga

SEQ ID NO: 61363 - RNA, 1707 nt, Artificial Sequence
  derived and/or modified sequence opt1 from hemagglutinin__InfluenzaA__ABA54915
auggagaaggugguccugcuccuggccaccgccagccuggugaaguccgaccagaucugcaucggcuaccacgcgaacaacagcaccgagcaggucgacacgaucauggagaagaacgugaccgugacccacgcccaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccucccccgccaacgaccugugcuaccccggggacuucaacgacuacgaggagcugaagcaccuccugagccggaucaaccacuucgagaagauccagaucaucccgaaguccagcugguccaaccacgaggcgagcuccggcgucagcgccgccugccccuaccacggcaagcccuccuucuuccgcaacgugguguggcugaucaagaagaacagcgccuaccccacgaucaagcgguccuacaacaacaccaaccaggaggaccuccugguccugugggggauccaccacccgaacgacgcggccgagcagaccaagcucuaccagaaccccaccacguacaucagcgugggcaccuccacccugaaccagcgccuggugcccaagaucgccacccggagcaaggucaacgggcaguccggccgcauggaguucuucuggacgauccucaagcccaacgacgccaucaacuucgagagcaacgggaacuucaucgccccggaguacgcguacaagaucgugaagaagggcgacagcgccaucaugaaguccgagcuggaguacggcaacugcaacaccaagugccagacccccaugggggccaucaacagcuccaugcccuuccacaacauccacccccugaccaucggcgagugcccgaaguacgucaagagcaaccggcucgugcuggccacggggcugcgcaacacgccccagcgggagcgccggcgcaagaagcggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgugaccaacaaggucaacagcaucaucgacaagaugaacacccaguucgaggccguggggcgcgaguucaacaaccuggagcggcgcaucgagaaccugaacaagaagauggaggacggcuuccucgacguguggaccuacaacgcggagcugcugguccucauggagaacgagcggacccuggacuuccacgacuccaacgugaagaaccuguacaacaagguccgccuccagcugcgggacaacgccaaggagcuggggaacggcugcuucgaguucuaccacaagugcgacaacgagugcauggagagcgugaagaacggcaccuacgacuacccccaguacuccgaggaggcccgccucaaccgggaggagaucagcggggugaagcuggaguccaugggcacguaccagauccugagcaucuacuccaccgucgccagcucccucgcccuggcgaucaugguggccgggcugagccucuggaugugcuccaacggcagccugcagugccgcaucugcaucuga

SEQ ID NO: 61364 - RNA, 1698 nt, Artificial Sequence
  derived and/or modified sequence opt1 from hemagglutinin__InfluenzaA__ABA87080
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucaucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaugggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacccagaacgccaucaacggcaucaccaacaaggugaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcucaaccgcgagaagaucgacggcgugaagcuggaguccaugggcguguaccagauccuggccaucuacagcacggucgccagcucccucgugcugcuggugagccucggggccaucuccuucuggaugugcagcaacggcucccugcagugccggaucugcaucuga

SEQ ID NO: 61365 - RNA, 1698 nt, Artificial Sequence; identical to SEQ ID NO: 61304
  derived and/or modified sequence opt1 from hemagglutinin__InfluenzaA__ABA87091

SEQ ID NO: 61366 - RNA, 1698 nt, Artificial Sequence; identical to SEQ ID NO: 61304
  derived and/or modified sequence opt1 from hemagglutinin__InfluenzaA__ABA87231

SEQ ID NO: 61367 - RNA, 1701 nt, Artificial Sequence; identical to SEQ ID NO: 61263
  derived and/or modified sequence opt1 from hemagglutinin__InfluenzaA__ABA87242

SEQ ID NO: 61368 - RNA, 1701 nt, Artificial Sequence; identical to SEQ ID NO: 61264
  derived and/or modified sequence opt1 from hemagglutinin__InfluenzaA__ABA87253

SEQ ID NO: 61369 - RNA, 1698 nt, Artificial Sequence
  derived and/or modified sequence opt1 from hemagglutinin__InfluenzaA__ABB02781
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucagcguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagagcaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcgugugcaucuga

SEQ ID NO: 61370 - RNA, 1698 nt, Artificial Sequence; identical to SEQ ID NO: 61309
  derived and/or modified sequence opt1 from hemagglutinin__InfluenzaA__ABB02792

SEQ ID NO: 61371 - RNA, 1698 nt, Artificial Sequence; identical to SEQ ID NO: 61307
  derived and/or modified sequence opt1 from hemagglutinin__InfluenzaA__ABB02803

SEQ ID NO: 61372 - RNA, 1698 nt, Artificial Sequence
  derived and/or modified sequence opt1 from hemagglutinin__InfluenzaA__ABB02814
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcgacaacgagugcauggagagcgugaagaacggcaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 61373 - RNA, 1698 nt, Artificial Sequence
  derived and/or modified sequence opt1 from hemagglutinin__InfluenzaA__ABB02825
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcgacaacgagugcauggagagcgugaagaacggcaccuacgacuaccccaaguacuccgaggagagcaagcucaaccgggagcgcaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 61374 - RNA, 1701 nt, Artificial Sequence
  derived and/or modified sequence opt1 from hemagglutinin__InfluenzaA__ABB02836
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcaaccagcagaccgugaucccgaacaucggcagccggccccgcguccgggacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaagagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 61375 - RNA, 1701 nt, Artificial Sequence
  derived and/or modified sequence opt1 from hemagglutinin__InfluenzaA__ABB02847
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaucggcgugacccagaacgggaccuccagcgccugcaagcgccgguccaacaacagcuucuucucccgccugaacuggcucacccaccugaaguucaaguaccccgcccugaacgugacgaugcccaacaacgagaaguucgacaagcucuacaucuggggcguccaccaccccgggaccgacaacgaccagaucagccuguacgcgcaggccuccggccggaucaccgugagcaccaagcgcagccagcagacggugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgugaaccgcaucacguacggcgccugcccccgguacgucaagcagaacacccugaagcucgcgaccgggaugcgcaacgugcccgagaagcagacccggggcaucuucggggccaucgccggcuucaucgagaacggcugggaggggaugguggacggcugguacggguuccgccaccagaacuccgagggcaucgggcaggccgccgaccugaaguccacgcaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacaccaucgaccucacggacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcgugguccugcucggguucaucaugugggccugccagaagggcaacauccggugcaacaucugcaucuga

SEQ ID NO: 61376 - RNA, 1701 nt, Artificial Sequence; identical to SEQ ID NO: 61055
  derived and/or modified sequence opt1 from hemagglutinin__InfluenzaA__ABB02858

SEQ ID NO: 61377 - RNA, 1701 nt, Artificial Sequence
  derived and/or modified sequence opt1 from hemagglutinin__InfluenzaA__ABB02869
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucguggagaacgggugggagggcauggucgacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgagguggaggggcgcauccaggaccuggagaaguacguggaggacaccaagaucgaccucugguccuacaacgccgagcugcuggucgcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 61378 - RNA, 1701 nt, Artificial Sequence
  derived and/or modified sequence opt1 from hemagglutinin__InfluenzaA__ABB02880
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaaccggaagcucaaccgccugaucgagaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacauggggaacggcugcuucaagaucuaccacaagugcgacaacgccugcaucggcuccauccgcaacgggaccuacgaccacgacgucuaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaaggggaacauccggugcaacaucugcaucuga

SEQ ID NO: 61379 - RNA, 1701 nt, Artificial Sequence
  derived and/or modified sequence opt1 from hemagglutinin__InfluenzaA__ABB02891
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcuccaucaucagcaucuacuggaccaucgugaagcccggcgacauccuccugaucaacuccaccggcaaccugaucgcgccccggggguacuucaagauccggagcggcaaguccagcaucaugcgcuccaacgccccgaucggggagugcaacagcgagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 61380 - RNA, 1701 nt, Artificial Sequence
  derived and/or modified sequence opt1 from hemagglutinin__InfluenzaA__ABB02902
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugauggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggguucaucaugugggccugccagaagggcaacauccgcugcaacaucugcaucuga

SEQ ID NO: 61381 - RNA, 1698 nt, Artificial Sequence
  derived and/or modified sequence opt1 from hemagglutinin__InfluenzaA__ABB02913
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccggcccccgaacaucggcgaccagcgcgcccuguaccacacggagaacgccuacgugagcgucgugagcucccacuacagccggcgcuucacccccgagaucgccaagcggcccaaggugcgcgaccaggaggggcggaucaacuacuacuggacccuccuggagcccggcgacaccaucaucuucgaggcgaacgggaaccugaucgccccgugguacgccuucgcccucucccgcggcuucggcagcgggaucaucacguccaacgcccccauggacgagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaaccggaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61382 - RNA, 1698 nt, Artificial Sequence
  derived and/or modified sequence opt1 from hemagglutinin__InfluenzaA__ABB02924
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacgccgucaucgagaagaugaacacccaguucacggccguggggaaggaguucaacaagcuggagcggcgcauggagaaccucaacaagaaggucgacgacggcuuccuggacaucuggaccuacaacgcggagcugcucgugcugcuggagaacgagcggacccucgacuuccacgacagcaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcgucuaccagauccuggccaucuacuccacgguggccagcagccucgugcugcuggucucccucggggccaucagcuucuggaugugcuccaacggcagccugcagugccggaucugcaucuga

SEQ ID NO: 61383 - RNA, 1698 nt, Artificial Sequence
  derived and/or modified sequence opt1 from hemagglutinin__InfluenzaA__ABB02936
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggccacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 61384 - RNA, 1701 nt, Artificial Sequence
  derived and/or modified sequence opt1 from hemagglutinin__InfluenzaA__ABB02947
augaagaccaucaucgcccugagcuacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugcaggacuacgcgagccugcggucccucgucgccagcuccggcacgcuggaguucaacaacgagagcuucaacuggaccgggguggcccagaacggcaccuccuacgccugcaagcgccggagcaucaaguccuucuucagccgccugaacuggcuccaccagcugaaguacaaguacccggcgcugaacgugaccaugcccaacaacgacaaguucgacaagcucuacaucuggggcguccaccaccccuccacggacagcgaccagaccucccuguacgcccaggccagcgggcgggugaccgugagcaccaagcgcucccagcagacggucauccccaacaucgggagccggccgugggugcgcggcguguccagccggaucuccaucuacuggaccaucgucaagcccggcgacauccugcucaucaacagcaccgggaaccugaucgcgccccgcggcuacuucaagauccgguccgggaaguccuccaucaugcgcagcgacgcccccaucggcaagugcaacuccgagugcaucaccccgaacggcagcauccccaacgacaagcccuuccagaacgugaaccggaucacguacggggccugcccccgcuacgugaagcagaacacccugaagcucgccaccggcaugcggaacgucccggagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucagcuucgccaucagcugcuuccuccugugcgugguccugcucggcuucaucaugugggccugccagaagggcaacauccggugcaacaucugcaucuga

SEQ ID NO: 61385 - RNA, 1701 nt, Artificial Sequence; identical to SEQ ID NO: 61194
  derived and/or modified sequence opt1 from hemagglutinin__InfluenzaA__ABB02958

SEQ ID NO: 61386 - RNA, 1701 nt, Artificial Sequence; identical to SEQ ID NO: 61194
  derived and/or modified sequence opt1 from hemagglutinin__InfluenzaA__ABB02969

SEQ ID NO: 61387 - RNA, 1701 nt, Artificial Sequence
  derived and/or modified sequence opt1 from hemagglutinin__InfluenzaA__ABB02980
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcuccaucaucagcaucuacuggacgaucgucaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacagcgaggggaccggccaggccgcggaccugaaguccacgcaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacaugggcaacgggugcuucaagaucuaccacaagugcgacaacgccugcaucggcuccauccgcaacgggaccuacgaccacgacguguaccgcgacgaggcccugaacaaccgguuccagaucaagggcgucgagcugaaguccggguacaaggacuggauccucuggaucagcuucgccaucuccugcuuccugcugugcgugguccuccugggcuucaucaugugggccugccagaagggcaacauccgcugcaacaucugcaucuga

SEQ ID NO: 61388 - RNA, 1701 nt, Artificial Sequence
  derived and/or modified sequence opt1 from hemagglutinin__InfluenzaA__ABB02991
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacaacccccaccagauccuggacggcgagaacugcacccugaucgacgcccuccugggggacccccacugcgacggcuuccagaacaaggagugggaccuguucguggagcgguccaaggccuacagcaacugcuaccccuacgacgugccggacuacgcgucccuccgcagccuggucgccuccagcggcacgcuggaguucaacaacgaguccuucaacuggaccgggguggcccagaacggcaccagcuccgccugcaagcggcgcagcaacaaguccuucuucagccggcucaacuggcugcaccagcugaaguacaaguaccccgcgcucaacgugaccaugcccaacaacgagaaguucgacaagcuguacaucuggggcguccaccaccccuccacggacagcgaccagaucucccuguacgcccaggccagcgggcgcgugaccgugagcaccaagcggucccagcagaccgucaucccgaacaucgggagccgccccugggugcggggcguguccagcaucaucuccaucuacuggacgaucgucaagcccggcgacauccuccugaucaacagcaccgggaaccugaucgcgccccgcggcuacuucaagauccgguccggcaagagcuccaucaugcgcagcgacgccccgaucgggaagugcaacuccgagugcaucacccccaacggcagcauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacuccgaggggaccggccaggccgcggaccucaagagcacgcaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgcggaggacaugggcaacgggugcuucaagaucuaccacaagugcgacaacgccugcaucggcagcauccgcaacgggaccuacgaccacgacguguaccgcgacgaggcccugaacaaccgguuccagaucaagggcgucgagcugaaguccggguacaaggacuggauccucuggaucagcuucgccaucagcugcuuccugcugugcgugguccuccugggcuucaucaugugggccugccagaagggcaacauccgcugcaacaucugcaucuga

SEQ ID NO: 61389 - RNA, 1701 nt, Artificial Sequence
  derived and/or modified sequence opt1 from hemagglutinin__InfluenzaA__ABB03002
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcaacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucggguccggccccugggugcgcggcgugagcucccggaucagcaucuacuggacgaucgucaagcccggggacauccuccugaucaacuccaccggcaaccugaucgcgccccgcggguacuucaagauccggagcggcaaguccagcaucaugcgcuccgacgccccgaucggcaagugcaacagcgagugcaucacccccaacggguccauccccaacgacaagcccuuccagaacgugaaccggaucaccuacggcgccugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacagcgagggcaccgggcaggccgcggaccugaaguccacgcaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggcuucaucaugugggccugccagaaggggaacauccgcugcaacaucugcaucuga

SEQ ID NO: 61390 - RNA, 1701 nt, Artificial Sequence
  derived and/or modified sequence opt1 from hemagglutinin__InfluenzaA__ABB03013
augaagaccaucaucgcccugagcuacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccagcuccaccgggcgcaucugcgacagcccccaccggauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacgcuggaguucaacaacgaguccuucaacuggaccgggguggcccagaacggcaccagcuucgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccgggacggacagcgaccagaccucccuguacgcccaggccagcgggcgggugaccgugagcaccaagcgcucccagcagacggucaucccgaacaucggcagcggccccugggugcgcgggguguccagccggaucuccaucuacuggaccaucgucaagcccggcgacauccuccugaucaacagcaccgggaaccugaucgcgccccggggcuacuucaagauccgcuccggcaagagcuccaucaugcggagcgacgccccgaucgggaagugcaacuccgagugcaucacccccaacggcagcauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggcuucaucgagaacgggugggagggcaugguggacgggugguacggcuuccgccaccagaacuccgaggggacgggccaggccgcggaccucaagagcacccaggccgccaucaaccagaucaacggcaagcugaaccggcugaucgagaagaccaacgagaaguuccaccagaucgagaaggaguucaccgagguggaggggcgcauccaggaccuggagaaguacgucgaggacacgaagaucgaccucugguccuacaacgccgagcugcugguggcccucgagaaccagcacaccaucgaccugaccgacagcgagaugaacaagcuguucgagcggacccgcaagcagcuccgcgagaacgcggaggacaugggcaacgggugcuucaagaucuaccacaagugcgacaacgccugcaucggcuccauccggaacgggacguacgaccacgacguguaccgcgacgaggcccugaacaaccgguuccagaucaagggcgucgagcucaagagcggcuacaaggacuggauccuguggaucuccuucgccaccagcugcuuccugcugugcgugguccuccugggguucaucaugugggccugccagaagggcaacauccgcugcaacaucugcaucuga

SEQ ID NO: 61391 - RNA, 1701 nt, Artificial Sequence
  derived and/or modified sequence opt1 from hemagglutinin__InfluenzaA__ABB03024
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccuggauccggggcgugagcucccgcaucagcaucuacuggacgaucgugaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgucaaccgcaucaccuacggggccugcccgcgguacgugaagcagaacacgcucaagcuggccaccggcaugcgcaacgugcccgagaagcagacccgggggaucuucggcgccaucgccggguucaucgagaacggcugggagggcauggucgacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcguggagcugaaguccggguacaaggacuggauccucuggaucagcuucgccaucuccugcuuccugcugugcgucgugcuccugggcuucaucaugugggccugccagaagggcaacauccggugcaacaucugcaucuga

SEQ ID NO: 61392 - RNA, 1701 nt, Artificial Sequence
  derived and/or modified sequence opt1 from hemagglutinin__InfluenzaA__ABB03035
augaagaccaucaucgcccugagcuacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccagcuccaccgggcgcaucugcgacagcccccaccggauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacgcuggaguucaacaacgaguccuucaacuggaccgggguggcccagaacggcaccagcuucgccugcaagcgccgguccaucaagagcuucuucucccgccucaacuggcugcaccagcugaaguacaaguaccccgcgcucaacguggccaugcccaacaacgacaaguucgacaagcuguacaucuggggcguccaccaccccgggaccgacagcgaccagacgucccuguacgcccaggccagcgggcgggugaccgugagcaccaagcgcucccagcagaccgucaucccgaacaucggcagccggcccugggugcgcggcguguccagccggaucuccaucuacuggacgaucgucaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcgccugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggcggccgaccucaagagcacgcaggccgccaucaaccagaucaacggcaagcugaaccgccugaucgagaagaccaacgagaaguuccaccagaucgagaaggaguucaccgagguggagggccggauccaggaccuggagaaguacgucgaggacaccaagaucgaccucugguccuacaacgccgagcugcugguggcgcucgagaaccagcacacgaucgaccugaccgacagcgagaugaacaagcuguucgagcgcacccgcaagcagcuccgggagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagagcggcuacaaggacuggauccuguggaucuccuucgccacgagcugcuuccugcugugcgugguccuccugggcuucaucaugugggcgugccagaaggggaacauccggugcaacaucugcaucuga

SEQ ID NO: 61393 - RNA, 1701 nt, Artificial Sequence
  derived and/or modified sequence opt1 from hemagglutinin__InfluenzaA__ABB03046
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcuccggcaucagcaucuacuggacgaucgucaagcccggggacauccuccugaucaacuccaccggcaaccugaucgcgccccgcggguacuucaagauccggagcggcaaguccagcaucaugcgcuccgacgccccgaucggcaagugcaacagcgagugcaucacccccaacggguccauccccaacgacaagcccuuccagaacgugaaccggaucaccuacggcgccugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacagcgagggcaccgggcaggccgcggaccugaaguccacgcaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggcccuccugggcuucaucaugugggcgugccagaaggggaacauccgcugcaacaucugcaucuga

SEQ ID NO: 61394 - RNA, 1701 nt, Artificial Sequence
  derived and/or modified sequence opt1 from hemagglutinin__InfluenzaA__ABB03057
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaccagccuguacgcgcaggccuccggccggaucacggugagcaccaagcgcagccagcagaccgugaucccgaacaucggcucccggccccgcguccgggacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgugaaccgcaucaccuacggcgccugcccccgguacgucaagcagaacacccugaagcucgcgacggggaugcgcaacgugcccgagaagcagacccggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaagcugggcuacaaggacuggauccucuggaucuccuucgccaucagcugcuuccugcugugcguggcccuccugggguucaucaugugggccugccagaagggcaacauccggugcaacaucugcaucuga

SEQ ID NO: 61395 - RNA, 1701 nt, Artificial Sequence; identical to SEQ ID NO: 61294
  derived and/or modified sequence opt1 from hemagglutinin__InfluenzaA__ABB03068

SEQ ID NO: 61396 - RNA, 1701 nt, Artificial Sequence; identical to SEQ ID NO: 61251
  derived and/or modified sequence opt1 from hemagglutinin__InfluenzaA__ABB03079

SEQ ID NO: 61397 - RNA, 1701 nt, Artificial Sequence; identical to SEQ ID NO: 61251
  derived and/or modified sequence opt1 from hemagglutinin__InfluenzaA__ABB03090

SEQ ID NO: 61398 - RNA, 1698 nt, Artificial Sequence
  derived and/or modified sequence opt1 from hemagglutinin__InfluenzaA__ABB03101
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaagaaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucagcguggugagcucccacuacagccgccgguucacccccgagaucaccaagcgccccaagguccgggaccaggagggccgcaucaacuacuacuggacccuccuggagcccggggacacgaucaucuucgagaccaacggcaaccugaucgccccgugguacgcguucgcccucucccggggguucggcagcggcaucaucaccuccaacgcccccauggacgagugcgacgccaagugccagacgccccagggggccaucaacagcucccugcccuuccagaacgugcacccggugaccaucggcgagugccccaaguacguccgcagcgcgaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacccagaacgcgaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgccgagcugcucgugcugcuggagaacgagcgcacgcucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgucaagcuggacuccaugggcguguaccagauccuggccaucuacagcaccguggcgagcucccucguccugcuggugagccucggggccaucuccuucuggaugugcagcaacggcucccugcagugccgcaucugcaucuga

SEQ ID NO: 61399 - RNA, 1701 nt, Artificial Sequence
  derived and/or modified sequence opt1 from hemagglutinin__InfluenzaA__ABB03112
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaacaagaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacacgugcaucgagagcauccgcaacggcaccuacgaccacgacguguaccgcgacgaggcgcucaacaaccgguuccagaucaaggggguggagcugaaguccggcuacaaggacuggauccuguggaucagcuucgccaucagcugcuuccuccugugcgucgcccugcucggcuucaucaugugggccugccagaaggggaacauccgcugcaacaucugcaucuga

SEQ ID NO: 61400 - RNA, 1698 nt, Artificial Sequence
  derived and/or modified sequence opt1 from hemagglutinin__InfluenzaA__ABB03123
augaaggugaagcugcucguccugcugugcaccuucaccgccacguacgccgacaccaucugcaucggcuaccacgcgaacaacagcaccgacaccguggacacggugcucgagaagaacgucaccgugacccacuucgugaaccugcuggaggacucccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgcgagcagcucagcuccgugagcuccuucgagcgguucgagaucuucccgaaggagagcuccuggcccaaccacaccgucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucagccgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcgucuaccagauccuggccaucuacuccacgguggccagcagccucgugcugcuggucucccucggggccaucagcuucuggaugugcuccaacggcagccugcagugccggaucugcaucuga

SEQ ID NO: 61401 - RNA, 1698 nt, Artificial Sequence
  derived and/or modified sequence opt1 from hemagglutinin__InfluenzaA__ABB03134
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgagaagaacgggcuguaccccacgcugagcaaguccuacgccaacaacaaggagaaggaggugcucauccuguggggcgugcaccacccgcccaacaucggggaccagcggacccuguaccacaccgagaacgccuacgucagcguggugagcucccacuacagccgccgguucacccccgagaucacgaagcgccccaagguccgggaccaggagggccgcaucaacuacuacuggacccuccuggagcccggcgacaccaucaucuucgaggccaacgggaaccugaucgccccgugguacgcguucgcccucucccggggcuucgggagcggcaucaucaccuccaacgcccccauggacgagugcgacgccaagugccagacgccccagggcgccaucaacagcucccugcccuuccagaacgugcacccggugaccaucggggagugccccaaguacguccgcagcgcgaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgccgaccagaaguccacgcagaacgcgaucaacggcaucaccaacaaggucaacagcgugaucgagaagaugaacacccaguucaccgccgugggcaaggaguucaacaagcuggagcgccggauggagaaccucaacaagaaggucgacgacggguuccuggacaucuggacguacaacgccgagcugcucgugcugcuggagaacgagcgcacccucgacuuccacgacagcaacgucaagaaccuguacgagaaggugaagucccagcugaagaacaacgccaaggagaucggcaacgggugcuucgaguucuaccacaagugcaacaacgagugcauggagagcgugaagaacggcaccuacgacuaccccaaguacuccgaggagagcaagcucaaccgggagaagaucgacggggucaagcuggaguccaugggcguguaccagauccuggccaucuacagcaccguggcgagcucccucguccugcuggugagccucggcgccaucuccuucuggaugugcagcaacgggucccugcagugccgcaucugcaucuga

SEQ ID NO: 61402 - RNA, 1698 nt, Artificial Sequence; identical to SEQ ID NO: 61307
  derived and/or modified sequence opt1 from hemagglutinin__InfluenzaA__ABB03145

SEQ ID NO: 61403 - RNA, 1701 nt, Artificial Sequence
  derived and/or modified sequence opt1 from hemagglutinin__InfluenzaA__ABB04283
augaagaccaucaucgcccugagcuacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcuccaaggccuucuccaacugcuaccccuacgacgugccggacuacgcgagccugcggucccucgucgccagcuccggcacgcuggaguucaucaacgagggguucaacuggaccggcgugacccagagcgggggcuccuacgccugcaagcgcgggagcgacaaguccuucuucagccggcugaacuggcucuacgaguccgagagcaaguaccccgcccugaacgugaccaugcccaacaacggcaacuucgacaagcuguacaucuggggcguccaccaccccuccacggacaaggagcagaccaaccucuacgugcgcgcgagcgggcgggugaccgucagcaccaagcgcucccagcagacgaucaucccgaacaucggcccccggcccugggugcgcgggcugagcucccggaucagcaucuacuggaccaucgugaagcccggcgacauccugcucaucaacuccagcggcaaccugaucgccccgcgcggguacuucaagauccggaccggcaaguccagcaucaugcgcuccgacgcccccaucgggaccugcagcuccgagugcaucacgcccaacggcagcauccccaacgacaagccguuccagaacgucaacaagaucaccuacggggccugccccaaguacgugaagcagaacacccugaagcucgccaccggcaugcggaacauccccgagaagcagacgcgcggcaucuucggggcgaucgccggcuucaucgagaacgggugggagggcaugguggacgggugguacggcuuccggcaccagaacuccgagggcaccgggcaggccgccgaccucaagagcacccaggccgcgaucgaccagaucaacggcaagcugaaccgcgucaucgagaagaccaacgagaaguuccaccagaucgagaaggaguucuccgagguggaggggcggauccaggaccucgagaaguacguggaggacacgaagaucgaccuguggagcuacaacgccgagcugcucgucgcccuggagaaccagcacaccaucgaccugaccgacuccgagaugaacaagcuguucgagaagacccgccggcagcugcgcgagaacgccgaggacaugggcaacgggugcuucaagaucuaccacaagugcgacaacgccugcaucggcagcauccgcaacggcacguacgaccacgacguguaccgggacgaggcgcugaacaaccgcuuccagaucaaggggguggagcucaaguccggcuacaaggacuggauccuguggaucagcuucgccaucagcugcuuccugcucugcgucgugcugcugggguucaucaugugggccugccagaagggcaacauccggugcaacaucugcaucuga

SEQ ID NO: 61404 - RNA, 1701 nt, Artificial Sequence
  derived and/or modified sequence opt1 from hemagglutinin__InfluenzaA__ABB04294
augaagaccaucaucgcccugagcuacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccagcaccggcaagaucugcaacaacccccaccgcauccuggacgggaucaacugcacccugaucgacgcccuccugggcgacccccacugcgacggcuuccagaacgagaagugggaccuguucguggagcgguccaaggccuucagcaacugcuaccccuacgacgugccggacuacgccucccuccgcagccuggucgcguccagcgggacgcuggaguucaucaacgagggcuucaacuggaccggggugacccagaacggcggguccaacgccugcaagcggggccccgacagcggcuucuucucccgccucaacuggcuguacaagagcggguccaccuaccccgugcugaacgucacgaugcccaacaacgacaacuucgacaagcucuacaucuggggcgugcaccacccgagcaccgaccaggagcagaccaaccuguacgugcaggccuccgggcgggucaccgugagcacgaagcgcucccagcagaccaucauccccaacaucggcagccggcccugggugcgcggccugagcucccggaucagcaucuacuggaccaucgucaagcccggggacauccucgugaucaacuccaacggcaaccugaucgccccgcgcggguacuucaagaugcggaccggcaagagcuccaucaugcgcagcgacgcgcccaucgggacgugcaucuccgagugcaucacccccaacggcagcauccccaacgacaagccguuccagaacgugaacaagaucaccuacggcgccugccccaaguacgucaagcagaacacccugaagcucgccacggggaugcggaacgugcccgagaagcagacccgcggcaucuucggggccaucgccggcuucaucgagaacgggugggagggcaugaucgacggcugguacggguuccggcaccagaacuccgagggcaccgggcaggcggccgaccucaagagcacccaggccgccaucgaccagaucaacggcaagcugaaccgcgugaucgagaagacgaacgagaaguuccaccagaucgagaaggaguucuccgaggucgaggggcggauccaggaccucgagaaguacguggaggacaccaagaucgaccuguggagcuacaacgccgagcugcucguggcgcuggagaaccagcacaccaucgaccugaccgacuccgagaugaacaagcuguucgagaagacgcgccggcagcugcgcgagaacgccgaggacaugggcaacggcugcuucaagaucuaccacaagugcgacaacgccugcaucgggagcauccggaacggcaccuacgaccacgacgucuaccgcgacgaggcccugaacaaccgcuuccagaucaaggggguggagcucaaguccggcuacaaggacuggauccuguggaucagcuucgccaucuccugcuuccugcucugcgucgugcugcugggcuucaucaugugggcgugccagaaggggaacauccggugcaacaucugcaucuga

SEQ ID NO: 61405 - RNA, 1701 nt, Artificial Sequence
  derived and/or modified sequence opt1 from hemagglutinin__InfluenzaA__ABB04305
augaagaccaucaucgcccugagcuacaucuucugccucguguucgcccagaagcugcccgagaacgacaacuccaccgcgacgcugugccucggccaccacgccgucccgaacgggacccuggugaagaccaucaccaacgaccagaucgaggugacgaacgccaccgagcugguccagagcuccagcaccggccgcaucugcgacagcccccaccggauccucgacgggaagaacugcacccugaucgacgcccugcucggcgacccccacugcgacggguuccagaacgagaagugggaccuguucguggagcgcagcaaggccuucuccaacugcuaccccuacgacgugccggacuacgcgagccugcggucccucgucgccagcuccggcacgcuggaguucaucaacgagggcuucaacuggaccggggugacccagagcggcggguccuacgccugcaagcgcggcagcgugaacuccuucuucagccggcugaacuggcucuacaaguccgagagcaaguaccccguccugaacgugaccaugcccaacaacgggaaguucgacaagcuguacaucuggggcgugcaccaccccuccacggacaaggagcagaccaaccucuacguccgcgccagcggcaaggugaccgugagcaccaagcggucccagcagacggucaucccgaacaucgggagccgccccugggugcggggccuguccagccgcaucuccaucuacuggaccaucgugaagcccggggacauccugcucaucaacagcaccggcaaccugaucgcgccccggggcuacuucaagauccgcaccgggaaguccagcaucaugcgguccgacgccccgaucggcacgugcagcuccgagugcaucacccccaacgggagcauccccaacgacaagcccuuccagaacgucaacaagaucaccuacggcgccugcccgcgcuacgugaagcagaacacccugaagcucgccacggggaugcggaacgugcccgagaagcagacccgcggcaucuucggcgccaucgcgggguucaucgagaacggcugggaggggauggucgacggcugguacggguuccggcaccagaacuccgagggcaccggccaggccgccgaccugaaguccacccaggccgccaucgaccagaucaacgggaagcugaaccgccucaucgagaagacgaacgagaaguuccaccagaucgagaaggaguucuccgagguggagggccggauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcgcaagcagcugcgggagaacgccgaggacauggggaacggcugcuucaagaucuaccacaagugcgacaacgccugcaucgggagcauccgcaacggcaccuacgaccacgacguguaccgcgacgaggcccucaacaaccgguuccagaucaagggcgucgagcugaaguccggguacaaggacuggauccuguggaucagcuucgcgaucagcugcuuccuccugugcguggugcugcucggcuucaucaugugggccugccagaaggggaacauccgcugcaacaucugcaucuga

SEQ ID NO: 61406 - RNA, 1701 nt, Artificial Sequence
  derived and/or modified sequence opt1 from hemagglutinin__InfluenzaA__ABB04316
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgagccugcggucccucgucgccagcuccggcacgcuggaguucaucaacgaggacuucaacuggaccggggugacccagagcggcggguccuacgccugcaagcgcggcagcgugaaguccuucuucagccggcugaacuggcuccacgaguccgaguacaaguaccccgcccugaacgucaccaugcccaacaacgggaaguucgacaagcuguacaucuggggcgugcaccaccccagcacggaccgcgagcagaccaaccucuacgugcgggcguccggccgcgucaccgugagcaccaagcggagccagcagacggugaucccgaacaucgggucccgccccuggguccggggccugagcucccgcaucagcaucuacuggaccaucgugaagcccggggacauccugcucaucaacuccaccggcaaccugaucgcgccccggggcuacuucaagauccgcaccgggaaguccuccaucaugcggagcgacgccccgaucggcacgugcuccagcgagugcaucacccccaacggguccauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgccggguucaucgagaacggcugggaggggaugguggacggcugguacggguuccggcaccagaacagcgagggcaccggccaggccgccgaccugaaguccacccaggccgcgaucgaccagaucaacgggaagcugaaccgccucaucgagaagacgaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucaccgacagcgagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaagggcguggagcucaagagcggguacaagaacuggauccuguggaucuccuucgccaucagcugcuuccugcugugcgucgugcugcucggcuucaucaugugggccugccagaaggggaacauccgcugcaacaucugcaucuga

SEQ ID NO: 61407 - RNA, 1701 nt, Artificial Sequence
  derived and/or modified sequence opt1 from hemagglutinin__InfluenzaA__ABB04327
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgagggguucaacuggaccggcgugacccagagcgggggcuccuacgccugcaagcgcgggagcgugaacuccuucuucagccggcugaacuggcucuacaaguccgaguacaaguaccccgcccugaacgucaccaugcccaacaacggcaaguucgacaagcuguacaucuggggcgugcaccaccccagcacggagaaggagcagaccaaccucuacgugcgcgcguccgggcgggucaccgugagcaccaagcgcagccagcagacggugaucccgaacaucggcuccauccccuggguccgggggcugagcucccgcaucagcaucuacuggaccaucgugaagcccggcgacauccugcucaucaacuccaccggcaaccugaucgcgccccggggguacuucaagauccgcaccggcaagagcuccaucaugcggagcgacgccccgaucgggacgugcuccagcgagugcaucacccccaacggcuccauccccaacgacaagcccuuccagaacgugaacaagaucaccuacggggccugcccgcgcuacgucaagcagaacacccugaagcucgccacgggcaugcggaacgugcccgagaagcagacccgcggcaucuucggggccaucgccggcuucaucgagaacgggugggagggcaugguggacgggugguacggcuuccggcaccagaacagcgagggcaccgggcaggccgccgaccugaaguccacccaggccgcgaucgaccagaucaacggcaagcugaaccgccucaucgagaagacgaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacaccaucgaccucaccgacagcgagaugaacaagcuguucgagaagacgcgcaagcagcugcgggagaacgccgaggacaugggcaacgggugcuucaagaucuaccacaagugcgacaacgccugcaucggcuccauccgcaacggcaccuacgaccacgacgucuaccgcgacgaggcgcucaacaaccgguuccagaucaaggggguggagcugaaguccggcuacaaggacuggauccuguggaucuccuucgccaucagcugcuuccuccugugcgucgugcugcucggguucaucaugugggccugccagaagggcaacauccgcugcaacaucugcaucuga

SEQ ID NO: 61408 - RNA, 1701 nt, Artificial Sequence
  derived and/or modified sequence opt1 from hemagglutinin__InfluenzaA__ABB04338
augaagaccaucaucgcccugagcuacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccagcaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccagcgggacccuggaguucaucaacgagggcuucaccuggaccggggugacgcagaacggcggguccaacgccugcaagcggggccccgacagcggcuucuucucccgccugaacuggcucuacaagagcggguccaccuaccccgugcugaacgucaccaugcccaacaacgacaacuucgacaagcuguacaucuggggcgugcaccacccgagcaccgaccaggagcagacgucccucuacgugcaggccagcgggcgggucaccguguccaccaagcgcagccagcagaccaucauccccaacaucggcagccggcccugggugcgcggccuguccagccggaucuccaucuacuggacgaucgucaagcccggggacauccuggugcucaacagcaacggcaaccugaucgccccgcgcggguacuucaagaugcggaccggcaaguccagcaucaugcgcuccgacgcgcccaucgggaccugcaucagcgagugcaucacccccaacggcuccauccccaacgacaagccguuccagaacgugaacaagaucacguacggcgccugccccaaguacgucaagcagaacacccugaagcucgccaccgggaugcggaacgugcccgagaagcagacccgcggccuguucggggccaucgccggcuucaucgagaacgggugggagggcaugaucgacggcugguacggguuccggcaccagaacagcgagggcacggggcaggcggccgaccugaaguccacccaggccgccaucgaccagaucaacggcaagcucaaccgcgugaucgagaagaccaacgagaaguuccaccagaucgagaaggaguucagcgaggucgaggggcggauccaggaccuggagaaguacguggaggacaccaagaucgaccugugguccuacaacgccgagcuccugguggcgcuggagaaccagcacacgaucgaccucaccgacagcgagaugaacaagcuguucgagaagacccgccggcagcugcgcgagaacgccgaggacaugggcaacggcugcuucaagaucuaccacaagugcgacaacgccugcaucggguccauccggaacggcaccuacgaccacgacgucuaccgcgacgaggcccucaacaaccgcuuccagaucaaggggguggagcucaagagcggcuacaaggacuggauccuguggaucuccuucgccaucagcugcuuccugcugugcgucgugcugcucggcuucaucaugugggcgugccagaaggggaacauccggugcaacaucugcaucuga

SEQ ID NO: 61409 - RNA, 1701 nt, Artificial Sequence
  derived and/or modified sequence opt1 from hemagglutinin__InfluenzaA__ABB04349
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgagggguucaacuggaccggcgugacccagagcgggggcuccuacgccugcaagcgcgggagcgugaacuccuucuucagccggcugaacuggcucuacaaguccgagagcaaguaccccguccugaacgugaccaugcccaacaacggcaaguucgacaagcuguacaucuggggcgugcaccaccccuccacggacaaggagcagaccaaccucuacguccgcgccagcgggaaggugaccgugagcaccaagcggucccagcagacggucaucccgaacaucggcagccgccccugggugcgggggcuguccagccgcaucuccaucuacuggaccaucgugaagcccggcgacauccugcucaucaacagcaccggcaaccugaucgcgccccggggguacuucaagauccgcaccggcaaguccagcaucaugcgguccgacgccccgaucgggacgugcaacagcgagugcaucacccccaacggcuccauccccaacgacaagcccuuccagaacgucaacaagaucaccuacggggccugcccgcgcuacgugaagcagaacacccugaagcucgccacgggcaugcggaacgugcccgagaagcagacccgcggcaucuucggggccaucgcgggcuucaucgagaacgggugggagggcauggucgacgggugguacggcuuccggcaccagaacagcgagggcaccgggcaggccgccgaccugaaguccacccaggccgccaucgaccagaucaacggcaagcugaaccgccucaucgagaagacgaacgagaaguuccaccagaucgagaaggaguucagcgagguggaggggcggauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcgcaagcagcugcgggagaacgccgaggacaugggcaacgggugcuucaagaucuaccacaagugcgacaacgccugcaucggcuccauccgcaacggcaccuacgaccacgacguguaccgcgacgaggcccucaacaaccgguuccagaucaagggggucgagcugaaguccggcuacaaggacuggauccuguggaucuccuucgcgaucagcugcuuccuccugugcguggugcugcucggguucaucaugugggccugccagaagggcaacauccgcugcaacaucugcaucuga

SEQ ID NO: 61410 - RNA, 1701 nt, Artificial Sequence
  derived and/or modified sequence opt1 from hemagglutinin__InfluenzaA__ABB04360
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgagccugcggucccucgucgccagcuccggcacgcuggaguucaucaacgaggacuucaacuggaccggggugacccagagcggcggguccuacgccugcaagcgcggcagcgugaacuccuucuucagccggcugaacuggcuccacaaguccgaguacaaguaccccgcccugaacgucaccaugcccaacaacgggaaguucgacaagcuguacaucuggggcgugcaccaccccagcacggaccgcgagcagaccaaccucuacgugcgggcguccggccgcgucaccgugagcaccaagcggagccagcagacggugaucccgaacaucgggucccgccccuggguccggggccugagcucccgcaucagcaucuacuggaccaucgugaagcccggggacauccugcucaucaacuccaccggcaaccugaucgcgccccggggcuacuucaagauccgcaccgggaaguccuccaucaugcggagcgacgccccgaucggcacgugcuccagcgagugcaucacccccaacggguccauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgccggguucaucgagaacggcugggaggggaugguggacggcugguacggguuccggcaccagaacagcgagggcaccggccaggccgccgaccugaaguccacccaggccgcgaucgaccagaucaacgggaagcugaaccgccucaucgagaagacgaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucaccgacagcgagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaagggcguggagcucaagagcggguacaaggacuggauccuguggaucuccuucgccaucagcugcuuccugcugugcgucgugcugcucggcuucaucaugugggccugccagaaggggaacauccgcugcaacaucugcaucuga

SEQ ID NO: 61411 - RNA, 1701 nt, Artificial Sequence
  derived and/or modified sequence opt1 from hemagglutinin__InfluenzaA__ABB04371
augaagaccaucaucgcccugagcuacaucuucuaccucgcccugggccaggaccugcccgggaacgacaacuccaaggcgacccucugccugggccaccacgccgugccgaacgggacgcuggucaagaccaucaccgacgaccagaccgaggugacgaacgccaccgagcucgugcagagcuccagcaccggcaagaucugcaacaacccccaccgcauccuggacgggauggacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcaccauggaguucaucaccgagggguucaccuggacggaggugacccagaacggcggguccaacgccugcaagcggggccccgacagcggguucuucucccgccugaacuggcucaccaagagcggccggaccuaccccgugcugaacgucacgaugcccaacaacgacaacuucgacaagcuguacaucuggggcgugcaccacccguccaccgaccaggagcagaccaaccucuacgugcagaccagcgggcgcgucacgguguccacccggcgcagccagcagaccaucauccccaacaucggcucccggcccugggugcgcgggcugagcagccggaucuccaucuacuggaccaucgucaagcccggcgacgugcuggugaucaacagcaacggcaaccucaucgccccgcgcggguacuucaagaugcggacgggcaaguccagcaucaugcgcuccgacgcgcccaucgacacgugcaucagcgagugcaucacccccaacggguccauccccaacgacaagccguuccagaacgucaacaagaucaccuacggcgccugccccaaguacgugaagcagaacacccugaagcuggccaccgggaugcggaacgugcccgagaagcagacccgcggccucuucggcgccaucgccggguucaucgagaacggcugggaggggaugaucgacggcugguacggguuccggcaccagaacagcgagggcaccggccaggcggccgaccugaaguccacgcaggccgccaucgaccagaucaacgggaagcugaaccgcaucaucgagaagaccaacgagaaguuccaccagaucgagaaggaguucagcgaggucgagggccggauccaggaccucgagaaguacguggaggacaccaagaucgaccugugguccuacaacgccgagcugcucguggcgcuggagaaccagcacaccaucgaccugacggacagcgagaugaacaagcuguucgagaagacccgccggcagcuccgcgagaacgccgaggacauggggaacggcugcuucaagaucuaccacaagugcgacaacgccugcaucgaguccauccgcaacgggaccuacgaccacgacgucuaccgggacgaggcccugaacaaccgcuuccagaucaagggcguggagcucaagagcggcuacaaggacuggauccuguggaucuccuucgccaucagcugcuuccugcucugcgucgugcugcugggguucaucaugugggcgugccagcggggcaacauccgcugcaacaucugcaucuga

SEQ ID NO: 61412 - RNA, 1701 nt, Artificial Sequence
  derived and/or modified sequence opt1 from hemagglutinin__InfluenzaA__ABB04906
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagaacggcgacagcuacgccugcaagcgcggguccgugaaguccuucuucucccggcucaacuggcugcacaagagcgaguacaaguaccccgcgcugaacgucaccaugcccaacaacgacaaguucgacaagcucuacaucuggggcgugcaccaccccuccaccgaccgcgagcagacgagccuguacauccgggccuccgggaaggugaccgucagcaccaagcgcagccagcagaccgugaucccgaacaucggcucccggcccugggugcgcggccugagcucccggaucagcaucuacuggacgaucgucaagcccggggacauccuccugaucaacuccaccggcaaccugaucgcgccccgcggguacuucaagauccggaccggcaagagcuccaucaugcgcagcgacgccccgaucgggaccugcuccagcgagugcaucacgcccaacggcuccauccccaacgacaagcccuuccagaacgugaaccggaucaccuacggcgccugcccgcgcuacgugaagcagaacacccucaagcuggccaccgggaugcggaacguccccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucgaccagaucaacggcaagcucaaccgccugaucgagaagaccaacgagaaguuccaccagaucgagaaggaguucagcgagguggagggccggauccaggaccuggagaaguacgucgaggacacgaagaucgaccucugguccuacaacgccgagcugcugguggcccucgagaaccagcacaccaucgaccugaccgacagcgagaugaacaagcuguucgagaagacccgcaagcagcuccgcgagaacgccgaggacauggggaacggcugcuucaagaucuaccacaagugcgacaacgcgugcaucggguccauccggaacggcacguacgaccacgacguguaccgcgacgaggcccugaacaaccgguuccagaucaagggggucgagcucaagagcggcuacaaggacuggauccuguggaucuccuucgccaucagcugcuuccugcugugcgugguccuccugggcuucaucaugugggccugccagaaggggaacauccgcugcaacaucugcaucuga

SEQ ID NO: 61413 - RNA, 1701 nt, Artificial Sequence
  derived and/or modified sequence opt1 from hemagglutinin__InfluenzaA__ABB04917
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagaucagcuccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucagcaacugcuaccccuacgacgugccggacuacgcgucccugcggagccucgucgccuccagcggcacgcuggaguucaucaacgagggguucaacuggaccggcgugacccaguccgggggcagcuacacgugcaagcgcggguccgugaacagcuucuucucccggcugaacuggcucuacgagagcgaguccaaguaccccguccugaacgugaccaugcccaacaacggcaaguucgacaagcuguacaucuggggcgugcaccaccccagcaccgacaaggagcagaccaaccucuacguccgcgccuccgggcgggugaccgugagcacgaagcgcagccagcagaccgucaucccgaacaucggcucccggcccugggugcgcgggcugagcucccggaucagcaucuacuggaccaucgugaagcccggcgacauccugcucaucaacuccaccggcaaccugaucgcgccccgcggguacuucaagauccggacgggcaagagcuccaucaugcgcagcgacgccccgaucgggaccugcuccagcgagugcaucacccccaacggcuccauccccaacgacaagcccuuccagaacgucaacaagaucaccuacggggccugcccgcgguacgugaagcagaacacgcugaagcucgccaccggcaugcgcaacgugcccgagaagcagacccggggcaucuucggggccaucgccggcuucaucgagaacgggugggagggcauggucgacgggugguacggcuuccgccaccagaacagcgagggcaccgggcaggcggccgaccugaaguccacgcaggccgccaucgaccagaucaacggcaagcugaaccggcucaucgagaagaccaacgagaaguuccaccagaucgagaaggaguucagcgagguggaggggcgcauccaggaccuggagaaguacguggaggacaccaagaucgaccugugguccuacaacgccgagcuccuggucgcgcuggagaaccagcacaccaucgaccucacggacagcgagaugaacaagcuguucgagaagacccggaagcagcugcgcgagaacgccgaggacaugggcaacgggugcuucaagaucuaccacaagugcgacaacgccugcaucggcuccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggugcugcucggguucaucaugugggcgugccagaagggcaacauccggugcaacaucugcaucuga

SEQ ID NO: 61414 - RNA, 1701 nt, Artificial Sequence
  derived and/or modified sequence opt1 from hemagglutinin__InfluenzaA__ABB04928
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcaacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaucggcgugacccagaacgggggcuccaacgccugcaagcgggggaccgacagcggcuucuucucccgccugaacuggcucuacaagagcggcuccaccuaccccgugcagaacgucacgaugcccaacaacgacaacagcgacaagcuguacaucuggggcgugcaccaccccuccaccgacaaggagcagaccgaccuguacgugcaggccagcgggaaggucaccguguccacgaagcggagccagcagaccaucaucccgaacguggggagccgccccuggguccggggccucuccagccgcaucuccaucuacuggaccaucgugaagcccggcgacauccuggugaucaacagcaacgggaaccugaucgcgccccggggcuacuucaagaugcgcaccgggaaguccagcaucaugcgguccgacgccccgaucggcacgugcagcuccgagugcaucacccccaacgggagcauccccaacgacaagcccuuccagaacgucaacaagaucaccuacggcgccugcccgaaguacgugaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucagcuucgcgaucuccugcuuccuccugugcguggugcugcucggcuucaucaugugggccugccagaagggcaacauccgcugcaacaucugcaucuga

SEQ ID NO: 61415 - RNA, 1701 nt, Artificial Sequence
  derived and/or modified sequence opt1 from hemagglutinin__InfluenzaA__ABB04939
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgagggguucaacuggaccggcgugacccagagcgggggcuccuacacgugcaagcgcgggagcgugaacuccuucuucagccggcugaacuggcucuacgaguccgagagcaaguaccccguccugaacgugaccaugcccaacaacggcaaguucgacaagcuguacaucuggggcgugcaccaccccuccaccgacaaggagcagaccaaccucuacguccgcgccagcgggcgggugaccgugagcacgaagcgcucccagcagaccgucaucccgaacaucggcagccggcccugggugcgcgggcuguccagccggaucuccaucuacuggaccaucgugaagcccggcgacauccugcucaucaacagcaucggcaaccugaucgcgccccgcggguacuucaagauccggaccggcaaguccagcaucaugcgcuccgacgccccgaucgggaucugcagcuccgagugcaucacgcccaacggcagcauccccaacgacaagcccuuccagaacgucaacaagaucaccuacggggccugcccgcgguacgugaagcagaacacccugaagcucgccaccggcaugcgcaacgugcccgagaagcagacgcggggcaucuucggggccaucgccggcuucaucgagaacgggugggagggcauggucgacgggugguacggcuuccgccaccagaacuccgagggcaccgggcaggcggccgaccugaaguccacccaggccgccguggaccagaucaacggcaagcugaaccggcucaucgagaagaccaacgagaaguuccaccagaucgagaaggaguucuccgagguggaggggcgcauccaggaccuggagaaguacgucgaggacacgaagaucgaccuguggagcuacaacgccgagcuccugguggcgcuggagaaccagcacaccaucgaccucaccgacuccgagaugaacaagcuguucgagaagacccggaagcagcugcgcgagaacgccgaggacaugggcaacgggugcuucaagaucuaccacaagugcgacaacgccugcaucggcagcauccgcaacggcacguacgaccacgacgucuaccgggacgaggcccucaacaaccgcuuccagaucaaggggguggagcugaaguccggcuacaaggacuggauccuguggaucagcuucgccaucagcugcuuccuccugugcgugguccugcucggguucaucaugugggcgugccagaagggcaacauccggugcaacaucugcaucuga

SEQ ID NO: 61416 - RNA, 1701 nt, Artificial Sequence
  derived and/or modified sequence opt1 from hemagglutinin__InfluenzaA__ABB04950
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgagggguucaacuggaccggcgugacccagagcgggggcuccuacacgugcaagcgcgggagcgugaacuccuucuucagccggcugaacuggcucuacgaguccgagagcaaguaccccguccugaacgugaccaugcccaacaacggcaaguucgacaagcuguacaucuggggcgugcaccaccccuccaccgacaaggagcagaccaaccucuacguccgcgccagcgggaaggugaccgugagcacgaagcggucccagcagaccgucaucccgaacaucggcagccgccccugggugcgggggcuguccagccgcaucuccaucuacuggaccaucgugaagcccggcgacauccugcucaucaacagcaccggcaaccugaucgcgccccggggguacuucaagauccgcacgggcaaguccagcaucaugcgguccgacgccccgaucgggaccugcagcuccgagugcaucacccccaacggcagcauccccaacgacaagcccuuccagaacgucaacaagaucaccuacggggccugcccgcgcuacgugaagcagaacacgcugaagcucgccaccggcaugcggaacgugcccgagaagcagacccgcggcaucuucggggccaucgccggcuucaucgagaacgggugggagggcauggucgacgggugguacggcuuccggcaccagaacuccgagggcaccgggcaggcggccgaccugaaguccacgcaggccgccaucgaccagaucaacggcaagcugaaccgccucaucgagaagaccaacgagaaguuccaccagaucgagaaggaguucuccgagguggaggggcggauccaggaccuggagaaguacguggaggacaccaagaucgaccuguggagcuacaacgccgagcuccuggucgcgcuggagaaccagcacaccaucgaccucacggacuccgagaugaacaagcuguucgagaagacccgcaagcagcugcgggagaacgccgaggacaugggcaacgggugcuucaagaucuaccacaagugcgacaacgccugcaucggcagcauccgcaacggcaccuacgaccacgacguguaccgcgacgaggcccucaacaaccgguuccagaucaagggggucgagcugaaguccggcuacaaggacuggauccuguggaucagcuucgccaucagcugcuuccuccugugcguggugcugcucggguucaucaugugggcgugccagaagggcaacauccgcugcaacaucugcaucuga

SEQ ID NO: 61417 - RNA, 1701 nt, Artificial Sequence
  derived and/or modified sequence opt1 from hemagglutinin__InfluenzaA__ABB04983
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgaccgcaucugcgacagcccccaccagauccuggacggggagaacugcacccugaucgacgcccuccugggcgacccccacugcgacggguuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccggcguggcccagaacgggaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcggccgcgugaccgucagcaccaagcggucccagcagaccgugaucccgaacaucgggagccgccccugggugcggggcgucuccagccgcaucuccaucuacuggacgaucgugaagcccggcgacauccuccugaucaacagcaccgggaaccugaucgcgccccggggcuacuucaagauccgcuccgggaaguccuccaucaugcggagcgacgccccgaucggcaagugcaacuccgagugcaucacccccaacggcagcauccccaacgacaagcccuuccagaacgugaaccgcaucaccuacgggccgugcccccgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagagcacgcaggccgcgaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgccugcaucggcagcauccgcaacgggaccuacgaccacgacguguaccgggacgaggcgcugaacaaccgcuuccagaucaagggcgucgagcugaaguccggguacaaggacuggauccucuggaucagcuucgccaucagcugcuuccugcugugcaucgugcuccugggcuucaucaugugggccugccagaagggcaacauccggugcaacaucugcaucuga

SEQ ID NO: 61418 - RNA, 1701 nt, Artificial Sequence; identical to SEQ ID NO: 61180
  derived and/or modified sequence opt1 from hemagglutinin__InfluenzaA__ABB04994

SEQ ID NO: 61419 - RNA, 1701 nt, Artificial Sequence
  derived and/or modified sequence opt1 from hemagglutinin__InfluenzaA__ABB05005
augaagaccaucaucgcccugagccacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccggacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccgugcccaacgacaagcccuuccagaacgucaaccgcaucacguacggcgccugcccgcgguacgugaagcagaacacccucaagcuggccaccgggaugcgcaacgugcccgagaagcagacccggggcaucuucggggccaucgccggcuucaucgagaacgggugggagggcauggucgacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgagguggaggggcgcauccaggaccuggagaaguacguggaggacaccaagaucgaccucugguccuacaacgccgagcugcuggucgcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 61420 - RNA, 1701 nt, Artificial Sequence
  derived and/or modified sequence opt1 from hemagglutinin__InfluenzaA__ABB05183
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgagcacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaaggucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 61421 - RNA, 1701 nt, Artificial Sequence
  derived and/or modified sequence opt1 from hemagglutinin__InfluenzaA__ABB05194
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaucaugcccaacaacgagaaguucgacaagcuguacaucuggggcguccaccaccccagcaccgacuccgaccagaucagccuguacgcccaggccagcgggcgcgugacgguguccaccaagcggagccagcagaccgucaucccgaacaucgggucccgccccugggugcggggcgugagcucccgcaucagcaucuacuggaccaucgucaagcccggcgacauccuccugaucaacuccacggggaaccugaucgcgccccggggcuacuucaagauccgcagcgggaaguccagcgugaugcgguccgacgccagcaucggcaagugcaacuccgagugcaucaccccgaacggcagcauccccaacgacaagcccuuccagaacgugaaccgcaucaccuacggggccugcccccgguacgucaagcagaacacccucaagcuggccacgggcaugcgcaacgugccggagaagcagacccgggggaucuucggcgccaucgccggguucaucgagaacggcugggagggcaugguggacgggugguacggcuuccgccaccagaacuccgaggggaccggccaggccgcggaccugaaguccacccaggccgccaucaaccagaucaacgggaagcucaaccggcugaucgagaagacgaacgagaaguuccaccagaucgagaaggaguucuccgaggucgagggccgcauccagaaccuggagaaguacguggaggacaccaagaucgaccucuggagcuacaacgccgagcugcugguggcccucgagaaccagcacaccaucgaccugaccgacuccgagaugaacaagcuguucgagcggacgaagaagcagcuccgcgagaacgcggaggacaugggcaacgggugcuucaagaucuaccacaagugcgacaacgccugcaucggcagcauccgcaacgggaccuacgaccacgacgucuaccgggacgaggcccugaacaaccgcuuccagaucaagggcguggagcucaagagcggguacaaggacuggauccuguggaucuccuucgccaucagcugcuuccugcugugcgucgugcuccugggcuucaucaugugggccugccagaagggcaacauccggugcaacaucugcaucuga

SEQ ID NO: 61422 - RNA, 1701 nt, Artificial Sequence
  derived and/or modified sequence opt1 from hemagglutinin__InfluenzaA__ABB05205
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaacgccuacuccaacugcuaccccuacgacgugccggacuacgcgagccuccgcucccuggucgccagcuccggcacgcuggaguucaacagcgaguccuucaacuggaccgggguggcccagaacggcaccagcuccgccugcaagcggcgcagcaacaaguccuucuucagccggcucaacuggcugcaccagcugaaguacaaguaccccgcgcucaacgugaccaugcccaacaacgagaaguucgacaagcuguacaucuggggcguccaccaccccgggacggacuccgaccagaucagccuguacgcccaggccagcgggcgcgugaccguguccaccaagcggagccagcagaccgucaucccgaacaucggcucccgccccugggugcggggcgugagcucccgcaucagcaucuacuggacgaucgucaagcccggggacauccuccugaucaacuccaccggcaaccugaucgcgccccggggguacuucaagauccgcagcggcaaguccagcaucaugcgguccgacgccccgaucggcaagugcaacagcgagugcaucacccccaacggguccauccccaacaacaagcccuuccagaacgugaaccgcaucaccuacggcgccugcccgcgguacgugaagcagaacacgcucaagcuggccaccgggaugcgcaacguccccgagaagcagacccggggcaucuucggggccaucgccggcuucaucgagaacggcugggaggggaugguggacggcugguacggguuccgccaccagaacagcgagggcaccgggcaggccgcggaccugaaguccacgcaggccgccaucaaccagaucaacggcaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggcuucaucaugugggccugccagaaggggaacauccggugcaacaucugcaucuga

SEQ ID NO: 61423 - RNA, 1701 nt, Artificial Sequence; identical to SEQ ID NO: 61080
  derived and/or modified sequence opt1 from hemagglutinin__InfluenzaA__ABB05216

SEQ ID NO: 61424 - RNA, 1701 nt, Artificial Sequence
  derived and/or modified sequence opt1 from hemagglutinin__InfluenzaA__ABB46392
augaagaccaucaucgcccugagcuacaucuucugccucgccuucgcgcaggaccugcccggcaacgacaacuccaccgccacgcugugccucgggcaccacgccgugccgaacggcacccuggucaagaccaucaccaacgaccagaucgaggugacgaacgccaccgagcuggugcagagcuccagcaccgggaagaucugcgacaacccccaccgcauccucgacggcaucaacugcacccugaucgacgcccugcucggggacccccacugcgacggcuuccagaacgagaagugggaccuguucgucgagcgguccaaggcguucagcaacugcuaccccuacgacgugccggacuacgccucccugcgcagccucguggccuccagcggcacgcuggaguucaucaacgagggguucaacuggaccggcgucacccagaacgggggcuccagcgccugcaagcgggggcccgacaacggcuucuucucccgccugaacuggcucuacaagagcggcuccaccuaccccgugcagaacgugacgaugcccaacaacgacaacagcgacaagcuguacaucuggggcguccaccacccgaacaccgacaaggagcagaccgaccuguacgugcaggcguccgggaaggugaccgucagcacgaagcggucccagcagaccaucauccccaacguggggagccgccccugggugcggggccucagcucccgcgucagcaucuacuggaccaucgugaagcccggcgacauccuggugaucaacuccaacgggaaccugaucgccccgcggggcuacuucaagaugcgcaccggcaagagcuccaucaugcggagcgacgcccccaucgggacgugcuccagcgagugcaucacccccaacggguccauccccaacgacaagccguuccagaacgucaacaagaucaccuacggcgccugccccaaguacgugaagcagaacacccucaagcuggccacgggcaugcgcaacgugcccgagaagcagacccgggggaucuucggcgcgaucgccggguucaucgagaacggcugggaggggaugaucgacggcugguacggcuuccgccaccagaacagcgaggggaccggccaggccgccgaccugaaguccacccagacggccaucgaccagaucaacgggaagcucaaccgggucaucgagaagaccaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucacggacagcgagaugaacaagcuguucgagaagacccggcgccagcugcgggagaacgccgaggacauggggaacggcugcuucaagaucuaccacaagugcgacaacgccugcaucggcuccauccgcaacgggaccuacgaccacgacguguaccgggacgaggcccucaacaaccgcuuccagaucaagggcgucgagcucaagagcggguacaaggacuggauccuguggaucuccuucgcgaucagcugcuuccugcugugcguggugcugcucggcuucaucaugugggccugccagaagggcaacauccgcugcaacaucugcaucuga

SEQ ID NO: 61425 - RNA, 1701 nt, Artificial Sequence
  derived and/or modified sequence opt1 from hemagglutinin__InfluenzaA__ABB46414
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccagcgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccagcacggacuccgaccagaccagccuguacgcccaggccagcgggcgggugaccguguccaccaagcgcagccagcagacggucaucccgaacaucgggucccggcccugggugcgcggcgugagcucccggaucagcaucuacuggaccaucgucaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccuguucugcgugguccugcucggcuucaucaugugggccugccagaagggcaacauccggugcaacaucugcaucuga

SEQ ID NO: 61426 - RNA, 1701 nt, Artificial Sequence
  derived and/or modified sequence opt1 from hemagglutinin__InfluenzaA__ABB46425
augaagaccaucaucgcccugagcuacauccucugccugguguucgcccagaagcugcccggcaacgacaacuccaccgcgacgcucugccuggggcaccacgccgucccgaacggcacccuggugaagaccaucaccagcgaccagaucgaggugacgaacgccaccgagcucguccaguccagcuccaccgggaagaucugcgacagcccccaccgcauccuggacggcgagaacugcacccugaucgacgcccuccugggggacccccacugcgacggcuuccagaacaaggagugggaccuguucguggagcgguccaaggccuacagcaacugcuaccccuacgacgugccggacuacgcgucccuccgcagccuggucgccuccagcggcacgcuggaguucaacaacgaguccuucaacuggaccgggguggcccagaacggcaccagcuucgccugcaagcggcgcuccaucaagagcuucuucucccggcucaacuggcugcaccagcugaaguacaaguaccccgcgcucaacgugaccaugcccaacaacgacaaguucgacaagcuguacaucuggggcguccaccaccccagcacggacuccgaccagaccagccuguacgcccaggccagcgggcgcgugaccguguccaccaagcggagccagcagacggucaucccgaacaucgggucccgccccugggugcggggcgugagcucccgcaucagcaucuacuggaccaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacagcgaggggacgggccaggccgcggaccugaaguccacccaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgguuccagaucaagggcgucgagcucaagagcggguacaaggacuggauccuguggaucagcuucgccaucuccugcuuccugcugugcgugguccuccugggcuucaucaugugggccugccagaagggcaacauccgcugcaacaucugcaucuga

SEQ ID NO: 61427 - RNA, 1701 nt, Artificial Sequence
  derived and/or modified sequence opt1 from hemagglutinin__InfluenzaA__ABB46436
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguacgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61428 - RNA, 1701 nt, Artificial Sequence; identical to SEQ ID NO: 61361
  derived and/or modified sequence opt1 from hemagglutinin__InfluenzaA__ABB46447

SEQ ID NO: 61429 - RNA, 1701 nt, Artificial Sequence
  derived and/or modified sequence opt1 from hemagglutinin__InfluenzaA__ABB46458
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcaaccagcagaccgugaucccgaacaucggcagccggccccgcguccgggacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaagagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucauguggggcugccagaaggggaacauccggugcaacaucugcaucuga

SEQ ID NO: 61430 - RNA, 1701 nt, Artificial Sequence
  derived and/or modified sequence opt1 from hemagglutinin__InfluenzaA__ABB51961
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuucuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgugcguccggucccugguggccagcuccgggacgcucgaguucaacaacgagagcuucaacugggccggcgugacccagaacgggaccuccagcgccugcaagcgccgguccaacaagagcuucuucucccgccugaacuggcugacccaccucaaguacaaguaccccgcgcugaacgucacgaugcccaacaacgagaaguucgacaagcuguacaucuggggcgugcaccaccccgggaccgacagcgaccagaucucccucuacgcccaggccagcggccggaucaccguguccacccagcgcugcaagcagcuggucaucccgaacaucggcagccggccccgcgugcgggacgugagcucccgcaucagcaucuacuggacgaucgucaaccccggggacauccugcucaucaacuccaccggcaaccugaucgcgccccggggguacuucaagauccgcagcggcaaguccagcaucaugcgguccgacgccccgaucggcaagugcaacagcgagugcaucacccccaacggguccauccccaacgacaagcccuuccagaacgugaaccgcaucaccuacggcgccugcccgcgguacgugaagcagaacacgcugaagcucgccaccgggaugcgcaacguccccgagaagcagacccggggcaucuucggggccaucgccggcuucaucgagaacggcugggaggggaugguggacggcugguacggguuccgccaccagaacagcgagggcaccgggcaggccgcggaccugaaguccacgcaggccgccaucaaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucacggacagcgagaugaacaagcuguucgagcggaccaagaagcagcugcgcgagaacgcggaggacaugggcaacgggugcuucaagaucuaccacaagugcgacaacgccugcaucgaguccauccgcaacggcaccuacgaccacgacguguaccgggacgaggcccucaacaaccgcuuccagaucaagggggucgagcucaagagcggcuacaaggacuggauccuguggaucuccuucgccaucagcugcuuccugcugugcguggcccugcucggcuucaucaugugggcgugccagaaggggaacauccggugcaacaucugcaucuga

SEQ ID NO: 61431 - RNA, 1698 nt, Artificial Sequence
  derived and/or modified sequence opt1 from hemagglutinin__InfluenzaA__ABB51962
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgccaugucccggggcuucggcagcgggaucuccacgagcaacgcccccaugggcgagugcgacgcgaaguuccagacgccccagggcgggaucaacaucucccuccccuuccagaacguccacccggugaccaucggggagugccccaacuacgugcgcagcgccaagcugcggauggucaccggccugcgcaacauccccuccauccagagccggggccucuucggggccaucgccggcuucaucgagggcggguggaccgggaugguggacggcugguacggcuaccaccaccagaacgagcagggguccggcuacgccgcggaccagaaguccacccagaacgccaucaacgggaucaccaacaaggugaacagcgucaucgagaagaugaacacccaguucacggccgugggcaaggaguucaacaagcuggagcgccggauggagaaccugaacaagaaggucgacgacggguuccucgacaucuggaccuacaacgccgagcugcuggugcuccuggagaacgagcgcacccuggacuuccacgacagcaacgugaagaaccucuacgagaaggucaagucccagcugaagaacaacgccaaggagaucggcaacggcugcagcgaguucuaccacaagugcaacaacgagugcauggaguccgugaagaacgggaccuacgacuaccccaaguacagcgaggaguccaagcugaaccgggagaagaucgacggcgugaagcucgagagcaugggggucuaccagauccuggcgaucuacagcacgguggccuccagccuggugcuccuggucucccugggcgccaucagcuucuggaugugcuccaacggcagccuccagugccgcaucugcaucuga

SEQ ID NO: 61432 - RNA, 1701 nt, Artificial Sequence
  derived and/or modified sequence opt1 from hemagglutinin__InfluenzaA__ABB51963
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccgcaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcggagcaaggccuacuccaacugcuaccccuacgacgugccggacuacgcgagccugcgcucccucgucgccagcuccgggacgcuggaguucaacaacgagagcuucaacuggaccggcgugacccagaacgggaccuccagcgccugcaagcggcgcuccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccgcaucaccgugagcacgaagcggagccagcagaccgugaucccgaacaucggcucccgcccccggguccgccacauccccagccggaucuccaucuacuggaccaucgugaaccccggggacauccugcucaucaacagcaccggcaaccugaucgccccgcgcggguacuucaagauccgguccggcaagagcuccaucaugcgcagcgacgcccccaucggcaagugcaacuccgagugcaucacgcccaacgggagcauccccaacgacaagccguuccagaacgugaaccggaucaccuacggcgccugcccccgcuacgucaagcagaacacccugaagcucgcgaccgggaugcggaacgugcccgagaagcagaaccgcggcaucuucggggccaucgccggcuucaucgagaacggcugggaggggaugguggacggcugguacggguuccggcaccagaacuccgagggcaucgggcaggccgccgaccugaaguccacgcaggcggccaucaaccagaucaacgagaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacaccaucgaccucacggacuccgagaugaacaagcuguucgagcgcaccaagaagcagcugcgcgagaacgccgaggacauggggaacggcugcuucaaggucuaccacaagugcgacaacgcgugcaucgggagcauccggaacggcaccuacgaccacaacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 61433 - RNA, 1701 nt, Artificial Sequence; identical to SEQ ID NO: 61290
  derived and/or modified sequence opt1 from Hemagglutinin__InfluenzaA__ABB51964

SEQ ID NO: 61434 - RNA, 1698 nt, Artificial Sequence
  derived and/or modified sequence opt1 from hemagglutinin__InfluenzaA__ABB53603
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaagaagaaggaggugcucauccuguggggcgugcaccacccgcccaacaucgggaaccagcggacccuguacuacacggagaacgccuacgucagcguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagagcaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcaucugcaucuga

SEQ ID NO: 61435 - RNA, 1701 nt, Artificial Sequence; identical to SEQ ID NO: 61263
  derived and/or modified sequence opt1 from hemagglutinin__InfluenzaA__ABB53614

SEQ ID NO: 61436 - RNA, 1701 nt, Artificial Sequence; identical to SEQ ID NO: 61263
  derived and/or modified sequence opt1 from hemagglutinin__InfluenzaA__ABB53625

SEQ ID NO: 61437 - RNA, 1701 nt, Artificial Sequence; identical to SEQ ID NO: 61290
  derived and/or modified sequence opt1 from hemagglutinin__InfluenzaA__ABB53652

SEQ ID NO: 61438 - RNA, 1701 nt, Artificial Sequence
  derived and/or modified sequence opt1 from hemagglutinin__InfluenzaA__ABB53663
augaagaccaucuucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggcccacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaacuucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61439 - RNA, 1701 nt, Artificial Sequence; identical to SEQ ID NO: 61263
  derived and/or modified sequence opt1 from hemagglutinin__InfluenzaA__ABB53685

SEQ ID NO: 61440 - RNA, 1701 nt, Artificial Sequence
  derived and/or modified sequence opt1 from hemagglutinin__InfluenzaA__ABB53696
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcaucgcccuccugggcuucaucaugugggcgugccagaagggcaacauccggugcaacgugugcaucuga

SEQ ID NO: 61441 - RNA, 1698 nt, Artificial Sequence; identical to SEQ ID NO: 61304
  derived and/or modified sequence opt1 from hemagglutinin__InfluenzaA__ABB53707

SEQ ID NO: 61442 - RNA, 1701 nt, Artificial Sequence; identical to SEQ ID NO: 61251
  derived and/or modified sequence opt1 from hemagglutinin__InfluenzaA__ABB53718

SEQ ID NO: 61443 - RNA, 1698 nt, Artificial Sequence
  derived and/or modified sequence opt1 from hemagglutinin__InfluenzaA__ABB53740
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaugggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggagaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 61444 - RNA, 1701 nt, Artificial Sequence
  derived and/or modified sequence opt1 from hemagglutinin__InfluenzaA__ABB53751
augaagaccaucaucgcccugagcuacaucuccugccucguguucgcccagaaccugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucagcaacugcuaccccuacgacgugccggacuacgcgucccugcggagccucgucgccuccagcggcacgcuggaguucaucaacgagggguucaacuggaccggcgugacccaguccgggggcagcuacgccugcaagcgcggguccgacaacagcuucuucucccggcugaacuggcucuacaagagcgaguccaaguaccccgugcugaacgucaccaugcccaacaacggcaacuucgacaagcuguacaucuggggcgugcaccaccccagcacggacaaggagcagaccaaccucuacgugcgcgccagcgggcgggucaccguguccaccaagcgcagccagcagacgaucaucccgaacaucggcucccggcccugggugcgcgggcugagcuccggcaucagcaucuacuggaccaucgucaagcccggcgacauccugcucaucaacuccaacgggaaccugaucgcgccccggggcuacuucaagauccgcaccggcaagagcuccauccugcggagcgacgccccgaucgggaccugcuccagcgagugcaucacgcccaacggguccauccccaacgacaagcccuuccagaacgugaacaagaucaccuacggcgccugcccgaaguacgugaagcagaacacccucaagcuggccaccggcaugcgcaacguccccgagaagcagacgcgggggaucuucggcgccaucgcgggguucaucgagaacggcugggaggggaugguggacggcugguacggcuuccgccaccagaacagcgaggggaccggccaggccgccgaccugaaguccacccaggccgccaucgaccagaucaacgggaagcucaaccgggugaucgagaagaccaacgagaaguuccaccagaucgagaaggaguucagcgaggucgagggccgcauccaggaccuggagaaguacguggaggacacgaagaucgaccugugguccuacaacgcggagcuccugguggcccuggagaaccagcacaccaucgaccucaccgacagcgagaugaacaagcuguucgagaagacccggcgccagcugcgggagaacgccgaggacauggggaacggcugcuucaagaucuaccacaagugcgacaacgccugcaucggcuccauccgcaacgggacguacgaccacgacgucuaccgcgacgaggcccucaacaaccgguuccagaucaagggcguggagcucaagagcggguacaaggacuggauccuguggaucagcuucgcgaucuccugcuuccugcugugcgucgugcugcucggcuucaucaugugggccugccagaagggcaacauccgcugcaacaucugcaucuga

SEQ ID NO: 61445 - RNA, 1701 nt, Artificial Sequence
  derived and/or modified sequence opt1 from hemagglutinin__InfluenzaA__ABB60007
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgaccgcaucugcgacagcccccaccggauccuggacggggagaacugcacccugaucgacgcccuccugggcgacccccacugcgacggguuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccggcguggcccagaacgggaccuccuacgccugcaagcgccggagcaucaaguccuucuucagccgccucaacuggcugcaccagcugaaguacaaguaccccgcgcucaacgugaccaugcccaacaacgacaaguucgacaagcuguacaucuggggcguccaccaccccuccacggacagcgaccagaccucccuguacgcccaggccagcgggcgggugaccgugagcaccaagcgcucccagcagacggucaucccgaacaucggcagccggcccugggugcgcgggguguccagccggaucuccaucuacuggaccaucgucaagcccggcgacauccuccugaucaacagcaccggcaaccugaucgcgccccgcggguacuucaagauccgguccggcaagagcuccaucaugcgcagcgacgccccgaucgggaagugcaacuccgagugcaucacccccaacggcagcauccccaacgacaagcccuuccagaacgugaaccggaucacguacggcgccugcccgcgcuacgugaagcagaacacccucaagcuggccaccgggaugcggaacguccccgagaagcagacccgcggcaucuucggggccaucgccggcuucaucgagaacgggugggagggcaugguggacggcugguacggguuccggcaccagaacuccgagggcacggggcaggccgcggaccugaaguccacccaggccgccaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacacgaucgaccugaccgacuccgagaugaacaagcuguucgagcgcacccgcaagcagcuccgggagaacgcggaggacaugggcaacggcugcuucaagaucuaccacaagugcgacaacgccugcaucgggagcauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcgugguccuccugggguucaucaugugggccugccagaagggcaacauccggugcaacaucugcaucuga

SEQ ID NO: 61446 - RNA, 1701 nt, Artificial Sequence
  derived and/or modified sequence opt1 from hemagglutinin__InfluenzaA__ABB77853
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaacaacgaguccuucaacuggaccgggguggcccagaacggcaccagcuacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccagcacggacuccgaccagaccagccuguacgcccaggccagcgggcgggugaccguguccaccaagcgcagccagcagacggucaucccgaacaucgggucccggcccugggugcgcggcgugagcucccggaucagcaucuacuggaccaucgucaagcccggcgacauccugcucaucaacuccaccgggaaccugaucgcgccccgcggcuacuucaagauccggagcgggaaguccagcaucaugcgcuccgacgccccgaucggcaagugcaacagcgagugcaucacccccgacggcuccauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagagcggguacaaggacuggauccuguggaucagcuucgccaucuccugcuuccugcugugcgugguccugcucggcuucaucaugugggccugccagaagggcaacauccggugcaacaucugcaucuga

SEQ ID NO: 61447 - RNA, 1701 nt, Artificial Sequence
  derived and/or modified sequence opt1 from hemagglutinin__InfluenzaA__ABB79731
augaagaccaucaucgcccugagcuacauccucugccugguguucgcccaggagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaccucccuguacgcgcaggccagcggccggaucacgguguccaccaagcgcagccagcagaccgugaucccgaacaucggcagccggccccgcguccgggacauccccucccgcaucagcaucuacuggaccaucgugaagcccggggacauccugcucaucaacuccacgggcaaccugaucgccccgcggggguacuucaagauccgcagcggcaaguccagcaucaugcgguccgacgcccccaucggcaagugcaacagcgagugcaucacccccaacggguccauccccaacgacaagccguuccagaacgugaaccgcaucaccuacggcgccugcccccgguacgucaagcagaacacccugaagcucgcgacggggaugcgcaacgugcccgagaagcagacccggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 61448 - RNA, 1701 nt, Artificial Sequence
  derived and/or modified sequence opt1 from hemagglutinin__InfluenzaA__ABB79788
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgagggguucaacuggaccggcgugacccagagcgggggcuccuacgccugcaagcgcgggagcgugaacuccuucuucagccggcugaacuggcucuacgaguccgagagcaaguaccccguccugaacgugaccaugcccaacaacggcaaguucgacaagcuguacaucuggggcgugcaccaccccaucacggacaaggagcagaccaaccucuacguccgcgccuccgggcgggugaccgugagcaccaagcgcagccagcagacggucaucccgaacaucggcucccggcccugggugcgcgggcugagcucccggaucagcaucuacuggaccaucgugaagcccggcgacauccugcucaucaacuccaccggcaaccugaucgcgccccgcggguacuucaagauccggaccggcaagagcuccaucaugcgcagcgacgccccgaucgggacgugcuccagcgagugcaucacccccaacggcuccauccccaacgacaagcccuuccagaacgucaacaagaucaccuacggggccugcccgcgguacgugaagcagaacacccugaagcucgccacgggcaugcgcaacgugcccgagaagcagacccggggcaucuucggggccaucgcgggcuucaucgagaacgggugggagggcauggucgacgggugguacggcuuccgccaccagaacagcgagggcaccgggcaggccgccgaccugaaguccacccaggccgccaucgaccagaucaacggcaagcugaaccggcucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggaagcagcugcgcgagaacgccgaggacaugggcaacgggugcuucaagaucuaccacaagugcgacaacgccugcaucggcuccauccgcaacggcaccuacgaccacgacguguaccgggacgaggcccucaacaaccgcuuccagaucaagggggucgagcugaaguccggcuacaaggacuggauccuguggaucuccuucgcgaucagcugcuuccuccugugcguggugcugcucggguucaucaugugggccugccagaagggcaacauccggugcaacaucugcaucuga

SEQ ID NO: 61449 - RNA, 1701 nt, Artificial Sequence
  derived and/or modified sequence opt1 from hemagglutinin__InfluenzaA__ABB79799
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgagggguucaacuggaccggcgugacccagagcgggggcuccuacgccugcaagcgcgggagcgugaacuccuucuucagccggcugaacuggcucuacgaguccgagagcaaguaccccguccugaacgugaccaugcccaacaacggcaaguucgacaagcuguacaucuggggcgugcaccaccccuccacggacaaggagcagaccaaccucuacguccgcgccagcgggaaggugaccgugagcaccaagcggucccagcagacggucaucccgaacaucggcagccgccccugggugcgggggcuguccagccgcaucuccaucuacuggaccaucgugaagcccggcgacauccugcucaucaacagcaccggcaaccugaucgcgccccggggguacuucaagauccgcaccggcaaguccagcaucaugcgguccgacgccccgaucgggacgugcagcuccgagugcaucacccccaacggcagcauccccaacgacaagcccuuccagaacgucaacaagaucaccuacggggccugcccgcgcuacgugaagcagaacacccugaagcucgccacgggcaugcggaacgugcccgagaagcagacccgcggcaucuucggggccaucgcgggcuucaucgagaacgggugggagggcauggucgacgggugguacggcuuccggcaccagaacuccgagggcaccgggcaggccgccgaccugaaguccacccaggccgccaucgaccagaucaacggcaagcugaaccgccucaucgagaagacgaacgagaaguuccaccagaucgagaaggaguucuccgagguggaggggcggauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcgcaagcagcugcgggagaacgccgaggacaugggcaacgggugcuucaagaucuaccacaagugcgacaacgccugcaucggcagcauccgcaacggcaccuacgaccacgacguguaccgcgacgaggcccucaacaaccgguuccagaucaagggggucgagcugaaguccggcuacaaggacuggauccuguggaucagcuucgcgaucagcugcuuccuccugugcguggugcugcucggguucaucaugugggccugccagaagggcaacauccgcugcaacaucugcaucuga

SEQ ID NO: 61450 - RNA, 1701 nt, Artificial Sequence
  derived and/or modified sequence opt1 from hemagglutinin__InfluenzaA__ABB79810
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgccugugcgacagcccccaccggauccuggacggcaagaacugcacccucaucgacgcccugcugggggacccccacugcgacggcuuccagaacaaggagugggaccucuucguggagcgcagcaaggccuacuccaacugcuaccccuacgacgugccggacuacgcgagccugcggucccuggucgccagcuccggcacgcucgaguucaucaacgaggacuucaacuggaccgggguggcccaggacggcgggagcuacgccugccgccggggcuccgugaacagcuucuucucccgccugaacuggcugcacaagcucgaguacaaguaccccgcgcugaacgucaccaugcccaacaacgggaaguucgacaagcuguacaucuggggcgugcaccaccccagcaccgacuccgaccagacgagccucuacgugcgggccuccggccgcgucaccgugagcaccaagcggagccagcagaccgugaucccgaacaucgggucccgccccuggguccggggccagagcucccgcaucagcaucuacuggacgaucgugaagcccggggacauccugcugaucgacuccaccggcaaccucaucgcgccccggggcuacuucaagauccgcaacgggaaguccuccaucaugcggagcgacgccccgaucggcaacugcuccagcgagugcaucacccccaacggguccauccccaacgacaagcccuuccagaacgugaaccgcaucaccuacggcgccugcccgcgguacgucaagcagcacacgcugaagcuggccaccgggaugcgcaacgugcccgagaagcagacccggggcaucuucggcgccaucgccggguucaucgagaacggcugggaggggaugguggacggcugguacggguuccgccaccagaacagcgagggcaccggccaggccgccgaccucaaguccacgcaggcggccaucgaccagaucaacgggaagcugaaccggcugaucgagaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacaccaucgaccugacggacagcgagaugaacaagcuguucgagcgcacccggaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 61451 - RNA, 1701 nt, Artificial Sequence
  derived and/or modified sequence opt1 from hemagglutinin__InfluenzaA__ABB79957
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgccugugcgacagcccccaccggauccuggacggcaagaacugcacccucaucgacgcccugcugggggacccccacugcgacggcuuccagaacaaggagugggaccucuucguggagcgcuccaaggccuacuccaacugcuaccccuacgacgugccggacuacgcgagccugcggucccuggucgccagcuccggcacgcucgaguucaucaacgaggacuucaacuggaccgggguggcccaggacggcgggagcuacgccugccgccggggcuccgugaacagcuucuucucccgccugaacuggcugcacaagcucgaguacaaguaccccgcgcugaacgucaccaugcccaacaacgggaaguucgacaagcuguacaucuggggcgugcaccaccccagcaccgacuccgaccagacgagccucuacgugcgggccuccggccgcgucaccgugagcaccaagcggagccagcagaccgugaucccgaacaucgggucccgccccuggguccggggccagagcucccgcaucgggaucuacuggacgaucgugaagcccggcgacauccugcugaucaacagcaccggcaaccucaucgcgccccggggguacuucaagauccgcaacggcaaguccagcaucaugcgguccgacgccccgaucgggaacugcagcuccgagugcaucacccccaacggcagcauccccaacgacaagcccuuccagaacgugaaccgcaucaccuacggggccugcccgcgguacgucaagcagcacacgcugaagcuggccaccggcaugcgcaacgugcccgagaagcagacccggggcaucuucggggccaucgccggcuucaucgagaacgggugggagggcaugguggacgggugguacggcuuccgccaccagaacuccgagggcaccgggcaggccgccgaccucaagagcacgcaggcggccaucgaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacaccaucgaccugacggacuccgagaugaacaagcuguucgagcgcacccggaagcagcuccgcgagaacgccgaggacaugggcaacgggugcuucaagaucuaccacaagugcgacaacgcgugcaucggcagcauccggaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 61452 - RNA, 1701 nt, Artificial Sequence
  derived and/or modified sequence opt1 from hemagglutinin__InfluenzaA__ABB79968
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgccugugcgacagcccccaccggauccuggacggcaagaacugcacccucaucgacgcccugcugggggacccccacugcgacggcuuccagaacaaggagugggaccucuucguggagcgcagcaaggccuacuccaacugcuaccccuacgacgugccggacuacgcgagccugcggucccuggucgccagcuccggcacgcucgaguucaucaacgaggacuucaacuggaccgggguggcccaggacggcgggagcuacgccugccgccggggcuccgugaacagcuucuucucccgccugaacuggcugcacaagcucgaguacaaguaccccgcgcugaacgucaccaugcccaacaacgggaaguucgacaagcuguacaucuggggcgugcaccaccccagcaccgacuccgaccagacgagccucuacgugcgggccuccggccgcgucaccgugagcaccaagcggagccagcagaccgugaucccgaacaucgggucccgccccuggguccggggccagagcucccgcaucagcaucuacuggacgaucgugaagcccggggacauccugcugaucaacuccaccggcaaccucaucgcgccccggggcuacuucaagauccgcaacgggaaguccuccaucaugcggagcgacgccccgaucggcaacugcuccagcgagugcaucacccccaacggguccauccccaacgacaagcccuuccagaacgugaaccgcaucaccuacggcgccugcccgcgguacgucaagcagcacacgcugaagcuggccaccgggaugcgcaacgugcccgagaagcagacccggggcaucuucggcgccaucgccggguucaucgagaacggcugggaggggaugguggacggcugguacggguuccgccaccagaacagcgagggcaccggccaggccgccgaccucaaguccacgcaggcggccaucgaccagaucaacgggaagcugaaccggcugaucgagaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacaccaucgaccugacggacagcgagaugaacaagcuguucgagcgcacccggaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 61453 - RNA, 1698 nt, Artificial Sequence
  derived and/or modified sequence opt1 from hemagglutinin__InfluenzaA__ABB79979
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuaccacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 61454 - RNA, 1698 nt, Artificial Sequence
  derived and/or modified sequence opt1 from hemagglutinin__InfluenzaA__ABB79990
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagaaggcccuguaccacacggagaacgccuacgugagcgucgugagcucccacuacagccggcgcuucacccccgagaucgccaagcggcccaaggugcgcgaccaggaggggcggaucaacuacuacuggacccuccuggagcccggcgacaccaucaucuucgaggcgaacgggaaccugaucgccccgugguacgccuucgcccucucccgcggcuucggcagcgggaucaucacguccaacgcccccauggacgagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 61455 - RNA, 1701 nt, Artificial Sequence
  derived and/or modified sequence opt1 from hemagglutinin__InfluenzaA__ABB80001
augaagaccaucaucgcccugagcuacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagagcuccagcaccgggggcaucugcgacagcccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacccuggaguucaacaacgagagcuucaacuggaccggcgugacccagaacgggacguccagcgccugcaagcgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucacggugagcaccaagcgcagccagcagaccgugaucccgaacaucggcucccggccccgcguccgggacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgugaaccgcaucaccuacggcgccugcccccgguacgucaagcaguccacccugaagcucgcgacggggaugcgcaacgugcccgagaagcagacccggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 61456 - RNA, 1701 nt, Artificial Sequence; identical to SEQ ID NO: 61251
  derived and/or modified sequence opt1 from hemagglutinin__InfluenzaA__ABB80012

SEQ ID NO: 61457 - RNA, 1701 nt, Artificial Sequence
  derived and/or modified sequence opt1 from hemagglutinin__InfluenzaA__ABB80023
augaagaccaucaucgcccugagcuacaucuucuaccucgcccugggccaggaccugcccgggaacgacaacuccaaggcgacccucugccugggccaccacgccgugccgaacgggacgcuggucaagaccaucaccaacgaccagaccgaggugacgaacgccaccgagcucgugcagagcuccagcaccggcaagaucugcaacaacccccaccgcauccuggacgggauggacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacggaggugacccagaacggcggguccaacgccugcaagcggggccccgacagcggguucuucucccgccucaacuggcugaccaagagcggccggaccuaccccgugcugaacgucacgaugcccaacaacgacaacuucgacaagcucuacaucuggggcgugcaccacccguccaccgaccaggagcagaccaaccuguacgugcagaccagcgggcgcgucacgguguccacccggcgcagccagcagaccaucauccccaacaucggcucccggcccugggugcgcgggcugagcagccggaucuccaucuacuggaccaucgucaagcccggcgacgugcucgugaucaacagcaacggcaaccugaucgccccgcgcggguacuucaagaugcggacgggcaaguccagcaucaugcgcuccgacgcgcccaucgacacgugcaucagcgagugcaucacccccaacggguccauccccaacgacaagccguuccagaacgucaacaagaucaccuacggcgccugccccaaguacgugaagcaggacacccugaagcucgccaccgggaugcggaacgugcccgagaagcagacccgcggccuguucggcgccaucgccggguucaucgagaacggcugggaggggaugaucgacggcugguacggguuccggcaccagaacagcgagggcaccggccaggcggccgaccugaaguccacgcaggccgccaucgaccagaucaacgggaagcucaaccgcaucaucgagaagaccaacgagaaguuccaccagaucgagaaggaguucagcgaggucgagggccggauccaggaccuggagaaguacguggaggacaccaagaucgaccugugguccuacaacgccgagcuccugguggcgcuggagaaccagcacaccaucgaccucacggacagcgagaugaacaagcuguucgagaagacccgccggcagcugcgcgagaacgccgaggacauggggaacggcugcuucaagaucuaccacaagugcgacaacgccugcaucgaguccauccgcaacgggaccuacgaccacgacgucuaccgggacgaggcccucaacaaccgcuuccagaucaagggcguggagcucaagagcggcuacaaggacuggauccuguggaucuccuucgccaucagcugcuuccugcugugcgucgugcugcucggguucaucaugugggcgugccagcggggcaacauccgcugcaacaucugcaucuga

SEQ ID NO: 61458 - RNA, 1701 nt, Artificial Sequence
  derived and/or modified sequence opt1 from hemagglutinin__InfluenzaA__ABB80034
augaagaccaucaucgcccugagcuacaucuucugccucgugcugggccaggaccugcccgggaacgacaacuccaccgccacgcucugccugggccaccacgcggucccgaacgggacccuggugaagaccaucaccgacgaccagaucgaggugacgaacgccaccgagcucguccagagcuccagcaccggcaagaucugcaacaacccccaccgcauccuggacgggcuggacugcacccucaucgacgcccugcugggcgacccccacugcgacguguuccagaacgagacgugggaccucuucguggagcgguccaaggccuucagcaacugcuaccccuacgacgucccggacuacgccucccugcgcagccugguggcguccagcggcacccucgaguucaucaccgagggguucaccuggacgggcgugacccagaacgggggcuccaacgccugcaagcgggggcccggcagcggcuucuucucccgccugaacuggcugaccaagagcggguccaccuaccccguccucaacgugacgaugcccaacaacgacaacuucgacaagcuguacaucuggggcgugcaccacccgagcaccaaccaggagcagaccucccuguacguccaggccagcgggcgggugaccguguccacgcgccggagccagcagaccaucauccccaacaucggcagccgccccuggguccggggccucuccagccgcaucuccaucuacuggaccaucgugaagcccggggacgugcuggucaucaacagcaacggcaaccugaucgccccgcggggguacuucaagaugcgcaccggcaaguccagcaucaugcgguccgacgcgacgaucgacacgugcaucagcgagugcaucacccccaacggguccauccccaacgacaagcccuuccagaacgugaacaagaucaccuacggcgccugcccgaaguacgugaagcagaacacccucaagcuggccaccggcaugcgcaacguccccgagaagcagacccgggggcuguucggcgccaucgccggguucaucgagaacggcugggaggggaugaucgacggcugguacggcuuccgccaccagaacagcgaggggaccggccaggcggccgaccucaaguccacgcaggccgccaucgaccagaucaacgggaagcugaaccgggugaucgagaagaccaacgagaaguuccaccagaucgagaaggaguucagcgagguggagggccgcauccaggaccuggagaaguacgucgaggacaccaagaucgaccucugguccuacaacgccgagcugcugguggcgcucgagaaccagcacaccaucgaccugacggacagcgagaugaacaagcuguucgagaagacccggcgccagcuccgggagaacgccgaggacauggggaacggcugcuucaagaucuaccacaagugcgacaacgccugcaucgaguccauccgcaacggcaccuacgaccacgacgucuaccgcgacgaggcccugaacaaccgguuccagaucaaggggguggagcucaagagcggcuacaaggacuggauccuguggaucuccuucgccaucagcugcuuccugcugugcgugguccuccugggguucaucaugugggcgugccagcgcggcaacauccggugcaacaucugcaucuga

SEQ ID NO: 61459 - RNA, 1698 nt, Artificial Sequence; identical to SEQ ID NO: 61372
  derived and/or modified sequence opt1 from hemagglutinin__InfluenzaA__ABB80045

SEQ ID NO: 61460 - RNA, 1701 nt, Artificial Sequence
  derived and/or modified sequence opt1 from hemagglutinin__InfluenzaA__ABB80081
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaacaacgaguccuucaacuggaccgggguggcccagaacggcaccagcuacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccagcacggacuccgaccagaccagccuguacgcccaggccagcgggcgggugaccguguccaccaagcgcagccagcagacggucaucccgaacaucgggucccggcccugggugcgcggcgugagcucccggaucagcaucuacuggaccaucgucaagcccggcgacauccugcucaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagagcggguacaaggacuggauccuguggaucagcuucgccaucuccugcuuccugcugugcgugguccugcucggcuucaucaugugggccugccagaagggcaacauccggugcaacaucugcaucuga

SEQ ID NO: 61461 - RNA, 1701 nt, Artificial Sequence
  derived and/or modified sequence opt1 from hemagglutinin__InfluenzaA__ABB80092
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaacaacgaguccuucaacuggaccgggguggcccagaacggcaccagcuacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccagcacggacuccgaccagaccagccuguacgcccaggccagcgggcgggugaccguguccaccaagcgcagccagcagacggucaucccgaacaucgggucccggcccugggugcgcggcgugagcucccggaucagcaucuacuggacccuggucaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagagcggguacaaggacuggauccuguggaucagcuucgccaucuccugcuuccugcugugcgugguccuccugggcuucaucaugugggccugccagaagggcaacauccggugcaacaucugcaucuga

SEQ ID NO: 61462 - RNA, 1701 nt, Artificial Sequence; identical to SEQ ID NO: 61263
  derived and/or modified sequence opt1 from hemagglutinin__InfluenzaA__ABB80137

SEQ ID NO: 61463 - RNA, 1701 nt, Artificial Sequence; identical to SEQ ID NO: 61460
  derived and/or modified sequence opt1 from hemagglutinin__InfluenzaA__ABB80159

SEQ ID NO: 61464 - RNA, 1701 nt, Artificial Sequence; identical to SEQ ID NO: 61031
  derived and/or modified sequence opt1 from hemagglutinin__InfluenzaA__ABB80185

SEQ ID NO: 61465 - RNA, 1701 nt, Artificial Sequence
  derived and/or modified sequence opt1 from hemagglutinin__InfluenzaA__ABB80207
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcgagaacugcacccugaucgacgcccuccugggggacccccacugcgacgacuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccggcguggcccagaacgggaccuccuacgccugcaagcgccggagcaucaaguccuucuucagccgccucaacuggcugcaccagcugaaguacaaguaccccgcgcucaacgugaccaugcccaacaacgacaaguucgacaagcuguacaucuggggcguccaccaccccuccacggacagcgaccagaccucccuguacgcccaggccagcgggcgggugaccgugagcaccaagcgcucccagcagacggucaucccgaacaucggcagccggcccugggugcgcgggguguccagccggaucuccaucuacuggaccaucgucaagcccggcgacauccuccugaucaacagcaccggcaaccugaucgcgccccgcggguacuucaagauccgguccggcaagagcuccaucaugcgcagcgacgccccgaucgggaagugcaacuccgagugcaucacccccaacggcagcauccccaacgacaagcccuuccagaacgugaaccggaucacguacggcgccugcccgcgcuacgugaagcagaacacccucaagcuggccaccgggaugcggaacguccccgagaagcagacccgcggcaucuucggggccaucgccggcuucaucgagaacgggugggagggcaugguggacggcugguacggguuccggcaccagaacuccgagggcacggggcaggccgcggaccugaaguccacccaggccgccaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacacgaucgaccugaccgacuccgagaugaacaagcuguucgagcgcacccgcaagcagcuccgggagaacgcggaggacaugggcaacggcugcuucaagaucuaccacaagugcgacaacgccugcaucgggagcauccgcaacggcaccuacgaccacgacguguaccgggacgaggcccugaacaaccgcuuccagaucaagggggucgagcugaaguccggcuacaaggacuggauccucuggaucagcuucgccaugagcugcuuccugcugugcgugguccuccugggguucaucaugugggccugccagaagggcaacauccggugcaacaucugcaucuga

SEQ ID NO: 61466 - RNA, 1701 nt, Artificial Sequence
  derived and/or modified sequence opt1 from hemagglutinin__InfluenzaA__ABB80229
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccuacgccugcaagcgccggagcaucaaguccuucuucagccgccucaacuggcugcaccagcugaaguacaaguaccccgcgcucaacgugaccaugcccaacaacgacaaguucgacaagcuguacaucuggggcguccaccaccccuccacggacagcgaccagaccucccuguacgcccaggccagcgggcgggugaccgugagcaccaagcgcucccagcagacggucaucccgaacaucgggagccggcccugggugcgcggcguguccagccggaucuccaucuacuggaccaucgucaagcccggcgacauccuccugaucaacagcaccgggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacacgaucgaccugaccgacuccgagaugaacaagcuguucgagcgcacccgcaagcagcuccgggagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcugaaguccggguacaaggacuggauccucuggaucagcuucgccaugagcugcuuccugcugugcgugguccuccugggcuucaucaugugggccugccagaagggcaacauccggugcaacaucugcaucuga

SEQ ID NO: 61467 - RNA, 1701 nt, Artificial Sequence; identical to SEQ ID NO: 61460
  derived and/or modified sequence opt1 from hemagglutinin__InfluenzaA__ABB80240

SEQ ID NO: 61468 - RNA, 1701 nt, Artificial Sequence
  derived and/or modified sequence opt1 from hemagglutinin__InfluenzaA__ABB80251
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccagcgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccagcacggacuccgaccagaccagccuguacgcccaggccagcgggcgggugaccguguccaccaagcgcagccagcagacggucaucccgaacaucgggucccggcccugggugcgcggcgugagcucccggaucagcaucuacuggaccaucgucaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggccugaucaugugggccugccagaagggcaacauccggugcaacaucugcaucuga

SEQ ID NO: 61469 - RNA, 1701 nt, Artificial Sequence
  derived and/or modified sequence opt1 from hemagglutinin__InfluenzaA__ABB80492
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggcgcaucugcgacagcccccaccggauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacgcuggaguucaacaacgaguccuucaacuggaccgggguggcccagaacggcaccagcuacgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccagcacggacuccgaccagaccagccuguacgcccaggccuccgggcgggugaccgugagcaccaagcgcagccagcagacggucaucccgaacaucgggucccggcccugggugcgcggcgugagcucccggaucagcaucuacuggaccaucgucaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagagcggguacaaggacuggauccuguggaucuccuucgccaugagcugcuuccugcugugcgugguccuccugggcuucaucaugugggccugccagaagggcaacauccggugcaacaucugcaucuga

SEQ ID NO: 61470 - RNA, 1701 nt, Artificial Sequence
  derived and/or modified sequence opt1 from hemagglutinin__InfluenzaA__ABB80503
augaagaccaucaucgcccugagcuacaucuccugccucguguucgcccagaagcugcccggcaacgacaacaacaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaacaacgagagcuucaacuggaccgggguggcccagaacggcaccuccuacgccugcaagcgccggagcaucaaguccuucuucagccgccugaacuggcuccaccagcugaaguacaaguaccccgcgcugaacgugaccaugcccaacaacgacaaguucgacaagcucuacaucuggggcguccaccaccccuccacggacagcgaccagaccucccuguacgcccaggccagcgggcgggugaccgugagcaccaagcgcucccagcagacggucaucccgaacaucgggagccggcccugggugcgcggcguguccagccggaucuccaucuacuggaccaucgucaagcccggcgacauccugcucaucaacagcaccgggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugcgguccggguacaaggacuggauccuguggaucagcuucgccaucagcugcuuccuccugugcgugguccugcucggcuucaucaugugggccugccagaagggcaacauccgcugcaacaucugcaucuga

SEQ ID NO: 61471 - RNA, 1701 nt, Artificial Sequence; identical to SEQ ID NO: 61460
  derived and/or modified sequence opt1 from hemagglutinin__InfluenzaA__ABB80514

SEQ ID NO: 61472 - RNA, 1701 nt, Artificial Sequence
  derived and/or modified sequence opt1 from hemagglutinin__InfluenzaA__ABB80529
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaacaacgaguccuucaacuggaccgggguggcccagaacggcaccagcuacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccagcacggacuccgaccagaccagccuguacgcccaggccagcgggcgggugaccguguccaccaagcgcagccagcagacggucaucccgaacaucgggucccggcccugggugcgcggcgugagcucccggaucagcaucuacuggaccaucgucaagcccggcgacauccugcucaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccugaagcucgccaccggcaugcggaacguccccgacaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagagcggguacaaggacuggauccuguggaucagcuucgccaucuccugcuuccugcugugcgugguccugcucggcuucaucaugugggccugccagaagggcaacauccggugcaacaucugcaucuga

SEQ ID NO: 61473 - RNA, 1701 nt, Artificial Sequence
  derived and/or modified sequence opt1 from hemagglutinin__InfluenzaA__ABB80641
augaagaccaucaucgcccugagcuacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugagcgacuacgcgucccugcggagccucgucgccuccagcggcacgcuggaguucaacaacgaguccuucaacuggaccgggguggcccagaacggcaccagcuacgccugcaagcgccgguccaucaagagcuucuucucccgccugaacuggcuccaccagcugaaguacaaguacccggcgcugaacgugaccaugcccaacaacgacaaguucgacaagcucuacaucuggggcguccaccaccccagcacggacuccgaccagaccagccuguacgcccaggccagcgggcgggugaccguguccaccaagcgcagccagcagacggucauccccaacaucgggucccggccgugggugcgcggcgugagcucccggaucagcaucuacuggaccaucgucaagcccggcgacauccugcucaucaacuccaccgggaaccugaucgcgccccgcggcuacuucaagauccggagcgggaaguccagcaucaugcgcuccgacgcccccaucggcaagugcaacagcgagugcaucaccccgaacggcuccauccccaacgacaagcccuuccagaacgugaaccggaucacguacggggccugcccccgcuacgugaagcagaacacccugaagcucgccaccggcaugcggaacgucccggagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcgugguccugcucggcuucaucaugugggccugccagaagggcaacauccggugcaacaucugcaucuga

SEQ ID NO: 61474 - RNA, 1701 nt, Artificial Sequence
  derived and/or modified sequence opt1 from hemagglutinin__InfluenzaA__ABB80661
augaagaccaucaucgcccugagcuacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaacaacgagagcuucaacuggaccgggguggcccagaacggcaccuccuacgccugcaagcgccggagcaucaaguccuucuucagccgccugaacuggcuccaccagcugaaguacaaguaccccgcgcugaacgugaccaugcccaacaacgacaaguucgacaagcucuacaucuggggcguccaccaccccuccacggacagcgaccaggccucccuguacgcccaggccagcgggcgggugaccgugagcaccaagcgcucccagcagaccgucaucccgaacaucgggagccggcccugggugcgcggcguguccagccggaucuccaucuacuggacgaucgucaagcccggcgacauccugcucaucaacagcaccgggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucaccuacggggccugcccgcgcuacgugaagcagaacacgcugaagcucgccaccggcaugcggaacguccccgagaagcagacccgcgggaucuucggcgccaucgccggguucaucgagaacggcugggagggcaugguggacgggugguacggcuuccggcaccagaacuccgaggggaccggccaggcggccgaccucaagagcacgcaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggagcuacaacgccgagcuccugguggcgcuggagaaccagcacaccaucgaccucacggacuccgagaugaacaagcuguucgagcgcacccgcaagcagcugcgggagaacgccgaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucagcuucgccaucagcugcuuccuccugugcgugguccugcucggcuucaucaugugggcgugccagaagggcaacauccggugcaacaucugcaucuga

SEQ ID NO: 61475 - RNA, 1701 nt, Artificial Sequence
  derived and/or modified sequence opt1 from hemagglutinin__InfluenzaA__ABB80672
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccaggggagcuccaccggccgcaucugcgacagcccccaccagauccuggacgggaagaacugcacccugaucgacgcccuccugggcgacccccacugcgacggcuuccagaacaaggagugggaccuguucguggagcgguccacggccuacagcaacugcuaccccuacgacgugccggacuacgcgucccuccgcagccuggucgccuccagcgggacccuggaguucaccaaggagggcuucaacuggaccgggguggcccaggacggcacguccuacgccugcaagcgggggagcgugaaguccuucuucagccgccucaacuggcugcacaagcuggaguacaaguaccccgcgcucaacgucaccaugcccaacaacgacaaguucgacaagcuguacaucuggggcgugcaccaccccuccaccgacagcgaccagaccucccuguacgugcaggccagcggccgggucacgguguccaccaagcgcagccagcagaccgugaucccgaacaucgggagccggcccuggguccgcggcguguccagccggaucuccaucuacuggaccaucgugaagcccggggacauccuccugaucaacagcacgggcaaccugaucgcgccccgcggcuacuucaagauccgguccggcaagagcuccaucaugcgcagcgacgccccgaucgacaacugcaacuccgagugcaucacccccaacgggagcauccccaacgacaagcccuuccagaacgucaaccggaucaccuacggggccugcccgcgcuacgugaagcagaacacccucaagcuggccacgggcaugcggaacgugcccgagaagcagacccgcgggaucuucggcgccaucgccggcuucaucgagaacgggugggagggcauggucgacgggugguacggcuuccggcaccagaacuccgaggggaccggccaggccgccgaccucaagagcacccaggcggccaucaaccagaucaacggcaagcugaaccgccugaucgagaagacgaacgagaaguuccaccagaucgagaaggaguucuccgagguggaggggcggauccaggaccuggagaaguacguggaggacaccaagaucgaccucuggagcuacaacgccgagcugcuggucgcccucgagaaccagcacaccaucgaccugaccgacuccgagaugaacaagcuguucgagcgcacgcggaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggcuacaaggacuggauccucuggaucagcuucgccaucuccugcuuccugcugugcguggugcuccugggguucaucaugugggccugccagaagggcaacauccggugcaacaucugcaucuga

SEQ ID NO: 61476 - RNA, 1701 nt, Artificial Sequence
  derived and/or modified sequence opt1 from hemagglutinin__InfluenzaA__ABB80682
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaacaacgaguccuucaacuggaccgggguggcccagaacggcaccagcuacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccagcacggacuccgaccagaccagccuguacgcccaggccagcgggcgggugaccguguccaccaagcgcagccagcagacggucaucccgaacaucgggucccggcccugggugcgcggcgugagcucccggaucagcaucuacuggaccaucgucaagcccggcgacauccugcucaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcugcuggagcgcacccgcaagcagcuccgggagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcucaagagcggguacaaggacuggauccuguggaucagcuucgccaucuccugcuuccugcugugcgugguccuccugggcuucaucaugugggccugccagaagggcaacauccggugcaacaucugcaucuga

SEQ ID NO: 61477 - RNA, 1701 nt, Artificial Sequence
  derived and/or modified sequence opt1 from hemagglutinin__InfluenzaA__ABB80693
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaugugcgacagcccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaacaacgaguccuucaacuggaccgggguggcccagaacggcaccagcuacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccagcacggacuccgaccagaccagccuguacgcccaggccagcgggcgggugaccguguccaccaagcgcagccagcagacggucaucccgaacaucgggucccggcccugggugcgcggcgugagcucccggaucagcaucuacuggaccaucgucaagcccggcgacauccugcucaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagagcggguacaaggacuggauccuguggaucagcuucgccaucuccugcuuccugcugugcgugguccugcucggcuucaucaugugggccugccagaagggcaacauccggugcaacaucugcaucuga

SEQ ID NO: 61478 - RNA, 1701 nt, Artificial Sequence
  derived and/or modified sequence opt1 from hemagglutinin__InfluenzaA__ABB80704
augaagaccaucaucgcccugagcuacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaacaacgagagcuucaacuggaccgggguggcccagaacggcaccuccuacgccugcaagcgccggagcaucaaguccuucuucagccgccugaacuggcuccaccagcugaaguacaaguaccccgcgcugaacgugaccaugcccaacaacgacaaguucgacaagcucuacaucuggggcguccaccaccccuccacggacagcgaccagaccucccuguacgcccaggccagcgggcgggugaccgugagcaccaagcgcucccagcagacggucaucccgaacaucgggagccggcccugggugcgcggcguguccagccggaucuccaucuacuggaccaucgucaagcccggcgacauccugcucaucaacagcaccgggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucagcuucgccaucagcugcuuccuccugugcgugguccugcucggcuucaucaugugggccugccagaagggcaacauccggugcaacaucugcaucuga

SEQ ID NO: 61479 - RNA, 1701 nt, Artificial Sequence; identical to SEQ ID NO: 61460
  derived and/or modified sequence opt1 from hemagglutinin__InfluenzaA__ABB80715

SEQ ID NO: 61480 - RNA, 1701 nt, Artificial Sequence
  derived and/or modified sequence opt1 from hemagglutinin__InfluenzaA__ABB80724
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccuacgccugcaagcgccggagcaucaaguccuucuucagccgccucaacuggcugcaccagcugaaguacaaguaccccgcgcucaacgugaccaugcccaacaacgacaaguucgacaagcuguacaucuggggcguccaccaccccuccacggacagcgaccaggccucccuguacgcccaggccagcgggcgggugaccgugagcaccaagcgcucccagcagaccgucaucccgaacaucgggagccggcccugggugcgcggcguguccagccggaucuccaucuacuggacgaucgucaagcccggcgacauccuccugaucaacagcaccgggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacuccgaggggaccggccaggcggccgaccucaagagcacgcaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcgcucgagaaccagcacaccaucgaccugacggacuccgagaugaacaagcuguucgagcgcacccgcaagcagcuccgggagaacgccgaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcugaaguccggguacaaggacuggauccucuggaucagcuucgccaugagcugcuuccugcugugcgugguccuccugggcuucaucaugugggcgugccagaagggcaacauccggugcaacaucugcaucuga

SEQ ID NO: 61481 - RNA, 1701 nt, Artificial Sequence; identical to SEQ ID NO: 61466
  derived and/or modified sequence opt1 from hemagglutinin__InfluenzaA__ABB80737

SEQ ID NO: 61482 - RNA, 1701 nt, Artificial Sequence
  derived and/or modified sequence opt1 from hemagglutinin__InfluenzaA__ABB80748
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaacaacgaguccuucaacuggaccgggguggcccagaacggcaccagcuacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccagcacggacuccgaccagaccagccuguacgcccaggccagcgggcgggugaccguguccacccagcgcagccagcagacggucaucccgaacaucgggucccggcccugggugcgcggcgugagcucccggaucagcaucuacuggaccaucgucaagcccggcgacauccugcucaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucagcgagguggagggccggauccaggaccuggaggaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagagcggguacaaggacuggauccuguggaucagcuucgccaucuccugcuuccugcugugcgugguccugcucggcuucaucaugugggccugccagaagggcaacauccggugcaacaucugcaucuga

SEQ ID NO: 61483 - RNA, 1701 nt, Artificial Sequence
  derived and/or modified sequence opt1 from hemagglutinin__InfluenzaA__ABB82183
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcgugaugcgguccgacgccagcaucggccgcugcaacuccgagugcaucaccccgaacggcagcauccccaacgacaagcccuuccagaacgugaaccggaucaccuacggggccugcccccgcuacgucaagcagaacacgcucaagcuggccaccggcaugcggaacgugccggagaagcagacccgcgggaucuucggcgccaucgccggguucaucgagaacggcugggagggcaugguggacgggugguacggcuuccggcaccagaacuccgaggggaccggccaggccgcggaccugaaguccacgcaggccgccaucaaccagaucaacgggaagcucaaccgccugaucgagaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagcgcaccaagaagcagcuccgcgagaacgcggaggacaugggcaacgggugcuucaagaucuaccacaagugcgacaacgccugcaucggcagcauccggaacgggaccuacgaccacgacgucuaccgcgacgaggcccugaacaaccgguuccagaucaagggcguggagcucaagagcggguacaaggacuggauccuguggaucuccuucgccaucagcugcuuccugcugugcgucgugcuccugggcuucaucaugugggccugccagaagggcaacauccgcugcaacaucugcaucuga

SEQ ID NO: 61484 - RNA, 1698 nt, Artificial Sequence; identical to SEQ ID NO: 61304
  derived and/or modified sequence opt1 from hemagglutinin__InfluenzaA__ABB82194

SEQ ID NO: 61485 - RNA, 1698 nt, Artificial Sequence
  derived and/or modified sequence opt1 from hemagglutinin__InfluenzaA__ABB82205
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuacaagaaccugcuguggcucaccgggaagaacggccuguaccccaaccugagcaaguccuacgccaacagcaaggagaaggaggugcucguccuguggggcgugcaccacccgcccaacaucggggaccagcgcgcccuguaccacacggagaacgccuacgugagcgucguguccagccacuacucccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucagccggggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagagcaugggcgucuaccagauccuggccaucuacagcacgguggccuccagccucgugcugcuggucucccucggggccaucagcuucuggaugugcuccaacggcagccugcagugccgcaucugcaucuga

SEQ ID NO: 61486 - RNA, 1698 nt, Artificial Sequence
  derived and/or modified sequence opt1 from hemagglutinin__InfluenzaA__ABB82216
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccagcuccugcagccacaacggcaaguccagcuucuaccgcaaccugcuguggcucaccgggaagaacggccuguaccccaaccuguccaagagcuacgugaacaacaaggagaaggagguccucgugcuguggggcgugcaccacccgcccaacaucggggaccagcgggcccuguaccacacggagaacgccuacgucagcgugguguccagccacuacucccgccgguucacccccgagaucgccaagcgccccaagguccgggaccaggagggccgcaucaacuacuacuggacccuccuggagcccggggacaccaucaucuucgaggccaacggcaaccugaucgccccgcgguacgcguucgcccucagccgcggguucggcuccggcaucaucacgagcaacgcccccauggacgagugcgacgccaagugccagacgccccagggggccaucaacuccagccugcccuuccagaacgugcacccggugaccaucggcgagugccccaaguacguccgguccgcgaagcugcgcauggugaccgggcuccggaacauccccagcauccagucccgcggccuguucggggccaucgccggcuucaucgagggcggguggaccggcaugguggacgggugguacggcuaccaccaccagaacgagcaggggagcggcuacgccgccgaccagaaguccacccagaacgcgaucaacggcaucaccaacaaggucaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucgugcugcuggagaacgagcggacccucgacuuccacgacuccaacgucaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacgguggcguccagccucguccugcuggugucccucggggccaucagcuucuggaugugcuccaacggcagccugcagugccggaucugcaucuga

SEQ ID NO: 61487 - RNA, 1701 nt, Artificial Sequence
  derived and/or modified sequence opt1 from hemagglutinin__InfluenzaA__ABB82227
augaagaccaucaucgcccugagcuacaucuucugccucacccugggccaggaccugcccgggaacgacaacuccaaggccacgcucugccugggccaccacgcggugccgaacgggacccuggucaagaccaucaccgacgaccagacggaggugaccaacgccaccgagcucgugcagagcuccagcaccggcaagaucugcaacaacccccaccgcauccuggacgggauggacugcacgcugaucgacgcccuccugggcgacccccacugcgacgucuuccagaacgagaccugggaccuguucguggagcgguccaaggccuucagcaacugcuaccccuacgacgugccggacuacgccucccuccgcagccuggcggccuccagcggcacccuggaguucaucaccgagggguucacguggaccggcgucacccagaacgggggcuccaacgccugcaagcgggggcccggcagcggcuucuucucccgccucaacuggcugaccaagagcgggaacacguaccccgugcugaacgugaccaugcccaacaacgacaacuucgacaagcucuacaucuggggcguccaccacccguccaccgaccaggagcagaccagccuguacgugcaggccuccgggcgggugacggucagcacccgccggucccagcagaccaucauccccaacaucggcagccgccccugggugcggggccugagcucccgcaucagcaucuacuggaccaucgugaagcccggggacguccucgugaucaacuccaacggcaaccugaucgcgccgcggggguacuucaagaugcgcacgggcaagagcuccaucaugcggagcgacgcccccaucgacacgugcaucuccgagugcaucacccccaacgggagcauccccaacgacaagccguuccagaacaucaacaagaucaccuacggcgccugccccaaguacgugaagcagaacacccugaagcucgccaccggcaugcgcaacguccccgagaagcagacccgggggcuguucggcgccaucgcgggguucaucgagaacggcugggaggggaugaucgacggcugguacggcuuccgccaccagaacuccgaggggaccggccaggccgccgaccucaagagcacgcaggccgccaucgaccagaucaacgggaagcucaaccggaucaucgagaagaccaacgagaaguuccaccagaucgagaaggaguucuccgagguggagggccgcauccaggaccuggagaaguacguggaggacaccaagaucgaccuguggagcuacaacgcggagcuccuggucgccauggagaaccagcacaccaucgaccugacggacuccgagaugaacaagcuguucgagaagacccggcgccagcugcgggagaacgccgaggacauggggaacggcugcuucaagaucuaccacaagugcgacaacgccugcaucgagagcauccgcaacggcaccuacgaccacgacguguaccgcgacgaggcccugaacaaccgguuccagaucaaggggguggagcucaaguccggcuacaaggacuggauccuguggaucagcuucgcgaucuccugcuuccugcucugcgucgugcugcugggguucaucaugugggccugccagcgcggcaacauccggugcaacaucugcaucuga

SEQ ID NO: 61488 - RNA, 1698 nt, Artificial Sequence
  derived and/or modified sequence opt1 from hemagglutinin__InfluenzaA__ABB83026
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgagaagaacgggcuguaccccaaccugagcaaguccuacgccaacaacaaggagaaggaggugcucauccuguggggcgugcaccacccgcccaacaucggggaccagcggacgcuguaccacaccgagaacgccuacgucagcguggugagcucccacuacagccgccgguucacccccgagaucaccaagcgccccaagguccgggaccaggagggccgcaucaacuacuacuggacgcuccuggagcccggcgacaccaucaucuucgaggccaacgggaaccugaucgccccgugguacgcguucgcccucucccggggcuucgggagcggcaucaucaccuccaacgcccccauggacgagugcgacgccaagugccagacgccccagggcgccaucaacagcucccugcccuuccagaacgugcacccggugaccaucggggagugccccaaguacguccgcagcgcgaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgccgaccagaaguccacccagaacgcgaucaacggcaucacgaacaaggucaacagcgugaucgagaagaugaacacccaguucaccgccgugggcaaggaguucaacaagcuggagcgccggauggagaaccucaacaagaaggucgacgacggguuccuggacaucuggaccuacaacgccgagcugcucgugcugcuggagaacgagcgcacgcucgacuuccacgacagcaacgucaagaaccuguacgagaaggugaagucccagcugaagaacaacgccaaggagaucggcaacgggugcuucgaguucuaccacaagugcaacaacgagugcauggagagcgugaagaacggcaccuacgacuaccccaaguacuccgaggagagcaagcucaaccgggagaagaucgacggggucaagcuggaguccaugggcguguaccagauccuggccaucuacagcaccguggcgagcucccucguccugcuggugagccucggcgccaucuccuucuggaugugcagcaacgggucccugcagugccgcaucugcaucuga

SEQ ID NO: 61489 - RNA, 1698 nt, Artificial Sequence
  derived and/or modified sequence opt1 from hemagglutinin__InfluenzaA__ABB83127
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucagcguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaucuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgucaagcuggacuccaugggcguguaccagauccuggcgaucuacagcacgguggccagcucccucguccugcuggugagccucggggccaucuccuucuggaugugcagcaacggcucccugcagugccgcaucugcaucuga

SEQ ID NO: 61490 - RNA, 1698 nt, Artificial Sequence
  derived and/or modified sequence opt1 from hemagglutinin__InfluenzaA__ABB83138
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcaucuccagcuucgagcgguucgagaucuucccgaaggaguccagcuggcccaaccacacggugaccgggguguccgccagcugcucccacaacggcaagagcuccuucuaccgcaaccugcuguggcucaccgggaagaacggccuguaccccaaccugagcaaguccuacgccaacaacaaggagaaggagguccucauccuguggggcgugcaccacccgcccaacaucggggaccagcggacccuguaccacacggagaacgccuacgugagcgucgugagcucccacuacagccgccgguucacccccgagaucaccaagcgccccaaggugcgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaagguggacgacggcuuccuggacaucuggaccuacaacgccgagcugcucguccugcuggagaacgagcgcacccucgacuuccacgacagcaacgugaagaaccuguacgagaaggucaagucccagcugaagaacaacgccaaggagaucgggaacggcugcuucgaguucuaccacaagugcaacaacgagugcauggagagcgugaagaacgggacguacgacuaccccaaguacuccgaggagagcaagcucaaccgggagaagaucgacggcgugaagcuggacuccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 61491 - RNA, 1701 nt, Artificial Sequence
  derived and/or modified sequence opt1 from hemagglutinin__InfluenzaA__ABB86877
augaaggccauccugcucauccugcuguacaccuucaccgccaccaacgcggacacccucugcaucggcuaccacgccaacaacagcaccgacaccguggacacgguccuggagaagaacgugaccgugacccacuccgucaaccugcucgaggaccgccacaacgggaagcugugcaaccugggcgggaucgcgccccucuaccugggcaacugcaacaucgccggguggcugcucggcaacccggagugcgagcugcuguucaccgugagcuccuggagcuacaucguggagacguccaacagcgacaacgggaccugcuaccccggcgacuucaucaacuacgaggagcuccgggagcagcuguccagcauguccagcuacgagcgcuucgagaucuuccccaaggaguccagcuggcccaaccacgagaccaaccggggcgucaccgccgccugcccguacgccggggccaacuccuucuaccgcaaccugaucuggcucgugaagaagggcaacagcuaccccaagaucaacaaguccuacgugaacaacaaggagaaggagguccuggugcugugggggauccaccacccgcccacgagcgccgaccagcagucccucuaccagaacgcggacgccuacgugagcgucgaguccagcaaguacaacaagaaguucaagcccgagaucgccacccggcccaaggugcgcggccaggccggccggaugaacuacuacuggacccugguggagcccggggacaccaucacguucgaggccaccggcaaccuggucgugccccgcuacgcguucgccaugaaccgggggagcggcuccggcaucaucaucagcgacaccccggugcacgacugcaacaccacgugccagacccccaagggggccaucaacaccucccuccccuuccagaacguccaccccgugaccaucggcgagugcccgaaguacgucaagagcacgaagcugcgcauggccaccgggcugcggaacauccccuccauccagagccgcggccucuucgaggccaucgcgggguucaucgagggcggcuggaccgggaugaucgacggcugguacggguaccaccaccagaacgagcagggcuccggguacgccgccgaccgcaagagcacccagaacgccaucgacggcaucacgaacaaggugaacuccgugaucgagaagaugaacacccaguucaccgccgugggcaaggaguucaaccaccuggagaagcggaucgagaaccugaacaagaaggucgacgacggguuccucgacguguggaccuacaacgcggagcugcugguccuccuggagaacgagcggacgcuggacuuccacgacagcaacgugaagaaccucuacgagaaggugcgcucccagcugcggaacaacgccaaggagaucggcaacgggugcuucgaguucuaccacaagugcgacgacacgugcauggagagcguccgcaacggcaccuacgacuaccugaaguacuccgaggagagcaagcucaaccgggagaagaucgagggggugaagcuggacuccgcccgcaucuaccagauccuggccaucuacagcaccguggccuccagccucguccugcuggugucccucggcgcgaucagcuucuggaugugcagcaacggcucccugcagugccggaucugcaucuga

SEQ ID NO: 61492 - RNA, 1701 nt, Artificial Sequence
  derived and/or modified sequence opt1 from hemagglutinin__InfluenzaA__ABB86887
augaaggccauccugcucauccugcuguacaccuucaccgccaccaacgcggacacccucugcaucggcuaccacgccaacaacagcaccgacaccguggacacgguccuggagaagaacgugaccgugacccacuccgucaaccugcucgaggaccgccacaacgggaagcugugcaaccugggcgggaucgcgccccucuaccugggcaacugcaacaucgccggguggcugcucggcaacccggagugcgagcugcuguucaccgugagcuccuggagcuacaucguggagacguccaacagcgacaacgggaccugcuaccccggcgacuucaucaacuacgaggagcuccgggagcagcuguccagcauguccagcuacgagcgcuucgagaucuuccccaaggaguccagcuggcccaaccacgagaccaaccggggcgucaccgccgccugcccguacgccggggccaacuccuucuaccgcaaccugaucuggcucgugaagaagggcaacagcuaccccaagaucaacaaguccuacgugaacaacaaggagaaggagguccuggugcugugggggauccaccacccgcccacgagcgccgaccagcagucccucuaccagaacgcggacgccuacgugagcgucgaguccagcaaguacaacaagaaguucaagcccgagaucgccacccggcccaaggugcgcggccaggccggccggaugaacuacuacuggacccugguggagcccggggacaccaucacguucgaggccaccggcaaccuggucgugccccgcuacgcguucgccaugaagcgggggagcggcuccggcaucaucaucagcgacaccccggugcacgacugcaacaccacgugccagacccccaagggggccaucaacaccucccuccccuuccagaacauccaccccgucaccaucggcgagugcccgaaguacgucaagagcacgaagcugcgcauggccaccgggcugcggaacauccccuccauccagagccgcggccucuucggggccaucgcgggcuucaucgagggcggguggaccggcaugaucgacgggugguacggcuaccaccaccagaacgagcagggguccggcuacgccgccgaccgcaagagcacccagaacgccaucgacggcaucacgaacaaggugaacuccgugaucgagaagaugaacacccaguucaccgccguggggaaggaguucaaccaccuggagaagcggaucgagaaccugaacaagaagguggacgacggcuuccucgacgucuggaccuacaacgcggagcugcuggugcuccuggagaacgagcggacgcuggacuuccacgacagcaacgucaagaaccucuacgagaaggugcgcucccagcugcggaacaacgccaaggagaucgggaacggcugcuucgaguucuaccacaagugcgacgacacgugcauggagagcgugcgcaacgggaccuacgacuaccugaaguacuccgaggagagcaagcucaaccgggagaagaucgagggcgucaagcuggacuccgcccgcaucuaccagauccuggccaucuacagcaccguggccuccagccucgugcugcuggucucccucggcgcgaucagcuucuggaugugcagcaacgggucccugcagugccggaucugcaucuga

SEQ ID NO: 61493 - RNA, 1698 nt, Artificial Sequence
  derived and/or modified sequence opt1 from hemagglutinin__InfluenzaA__ABB86899
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggccacuucgccgacuacgaggagcugcgcgagcagcucuccagcguguccagcuucgagcgguucgagaucuucccgaaggaguccagcuggcccaaccacacgaucaccgggguguccgccagcugcucccacaacggcaagcgcagcuucuaccggaaccugcuguggcucaccgggaagaacggccuguaccccaaccuguccaagagcuacgccaacaacaaggagaaggagguccucauccuguggggcgugcaccacccgcccaacaucggggaccagcgcacccuguaccacacggagaacgccuacguguccgucgugagcagccacuacucccggcgcuucacccccgagaucaccaagcggcccaaggugcgcgaccaggagggccggaucaacuacuacuggacccuccuggagcccggggacacgaucaucuucgaggccaacggcaaccugaucgcgccgugguacgccuucgcccucagccgcggguucggcuccggcaucaucaccagcaacgcccccauggacgagugcgacgccaagugccagacgccccagggggcgaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggugaacagcgucaucgagaagaugaacacgcaguucaccgccguggggaaggaguucuccaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggucaaggggcagcugaagaacaacgccaaggagaucggcaacgggugcuucgaguucuaccacaagugcaacaacgagugcauggaguccgugaagaacggcacguacgacuaccccaaguacagcgaggaguccaagcucaaccgcgagaagaucgacggcgugaagcuggacagcaugggggucuaccagauccuggcgaucuacuccaccguggccagcagccucauccugcuggugucccucggcgccaucagcuucuggaugugcuccaacgggagccugcagugccggaucugcaucuga

SEQ ID NO: 61494 - RNA, 1701 nt, Artificial Sequence
  derived and/or modified sequence opt1 from hemagglutinin__InfluenzaA__ABB86907
augaaggccauccugcucgugcugcuguacaccuucaccagcacgaacgccgacacccucugcaucggcuaccacgcgaacaacuccaccgacaccgucgacacggugcuggagaagaacgugaccgucacccacagcgugaaccugcucgaggacaagcacaacgggaagcugugccgccugggcgggaucgcgccccuccaccugggcaagugcaacaucgccggguggcugcucggcaacccggagugcgaccugcugcucaccguguccagcugguccuacaucgucgagacgagcaacuccuacaacgggaccugcuaccccggggacuucaccaacuacgaggagcugcgggagcagcugagcuccgugagcuccuucgagcgcuucgagaucuuccccaaggccagcuccuggcccaaccacgagaccaaccggggcgugacggccgccugcccgcacgccgggaccaacagcuucuaccgcaaccucaucuggcuggucaagaagggcaacaccuaccccaagcuguccaagagcuacgugaacaacaaggggaaggaggugcucguccuguggggcauccaccaccccuccaccagcacggaccagcagucccuguaccagaacgccgacaccuacguguucgugggcaccagcaaguacaacaagaaguucaagcccgagaucgccguccggccgaaggugaaggaccaggcggggcgcaugaacuacuacuggacccucguggagcccggcgacacgaucaccuucgaggccaccgggaaccuggucgugccccgguacgccuucgccaugaaccgcggccacggcagcgggaucaucaucuccgacacccccgugcacgacugcaacacgaccugccagaccccgaagggcgccaucaacaccagccugcccuuccagaacguccaccccgugacgaucgggaagugccccaaguacgugaaguccacccggcuccgcauggcgaccggccugcggaacaucccgagcauccagucccgcgggcuguucggcgccaucgccggcuucaucgagggcggcuggaccgggaugaucgacggcugguacggguaccaccaccagaacggccagggcagcggguacgccgccgaccagaaguccacgcagaacgcgaucgacggcaucaccaacaaggucaacagcgugaucgagaagaugaacacccaguucaccgccgucgggaaggaguucaaccaccucgagaagcggaucgagaaccugaacaagaagguggacgacggcuuccuggacguguggacguacaacgccgagcuccugguccugcucgagaacgagcgcacccuggacuuccacgacuccaacgugaagaaccuguacgagaaggugcggcgccagcucaagaacaacgccaaggagaucgggaacggcugcuucgaguucuaccacaacugcgacgacgccugcauggagagcgucaagaacggcaccuacgacuaccccaaguacuccgaggagagccggcugaaccgcgaggagaucaacgggaucaagcuggacuccacccggaucuaccagauccucgcgaucuacagcaccguggccuccagcuccgugcugcuggucagccucggcgccaucuccuucuggaugugcagcaacgggagccugcagugccgcaucugcaucuga

SEQ ID NO: 61495 - RNA, 1698 nt, Artificial Sequence
  derived and/or modified sequence opt1 from hemagglutinin__InfluenzaA__ABB86917
augaaggugaagcugcucauccugcugugcaccuucaccgccacguacgccgaccccaucugcaucggcuaccacgcgaacaacagcaccgacaccgucgacaccgugcucgagaagaacguggccgucacgcacuccgugaaccugcuggaggacagccacaacgggaagcucugccugcugaagggcaucgccccgcuccagcuggggaacugcuccguggccggcuggauccuggggaaccccgagugcgagcuccugaucagcaaggaguccuggagcuacaucgucgagacccccaaccccgagaacggcgccugcuacccgggcuacuucgcggacuacgaggagcugcgcgagcagcucuccagcguguccagcuucgagcgguucgagaucuuccccaaggaguccagcuggcccaaccacaccgugaccggggucuccgccagcugcucccacaacggcaagagcuccuucuaccgcaaccugcuguggcucacggggaagaacggccuguaccccaaccugagcaaguccuacgccaacaacaaggagaaggaggugcucauccuguggggcgugcaccacccgcccaacaucggggaccagcggacccuguaccacaccgagaacgccuacgucagcguggugagcucccacuacagccgccgguucacccccgagaucacgaagcgccccaagguccgggaccaggagggccgcaucaacuacuacuggacccuccuggagccgggggacaccaucaucuucgaggcgaacggcaaccugaucgcccccugguacgccuucgcccucucccggggguucggcagcggcaucaucaccuccaacgcccccauggacgagugcgacgcgaagugccagacgccccagggggccaucaacagcucccugccguuccagaacgugcaccccgugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacgcagaacgccaucaacggcaucaccaacaaggucaacagcgugaucgagaagaugaacacccaguucaccgccguggggaaggaguucaacaagcuggagcgccggauggagaaccucaacaagaaggucgacgacggcuuccuggacaucuggacguacaacgccgagcugcucgugcugcuggagaacgagcgcacccucgacuuccacgacagcaacgucaagaaccuguacgagaaggugaagucccagcugaagaacaacgcgaaggagaucgggaacggcugcuucgaguucuaccacaagugcaacaacgagugcauggagagcgugaagaacgggaccuacgacuacccgaaguacuccgaggagagcaagcucaaccgggagaagaucgacggcgucaagcuggacuccaugggcguguaccagauccuggccaucuacagcaccguggccagcucccucguccugcuggugagccucggggccaucuccuucuggaugugcagcaacggcucccugcagugccgcaucugcaucuga

SEQ ID NO: 61496 - RNA, 1698 nt, Artificial Sequence
  derived and/or modified sequence opt1 from hemagglutinin__InfluenzaA__ABB86929
augaaggugaagcugcucauccugcuguacaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggccacuucgccgacuacgaggagcugcgcgagcagcucuccagcguguccagcuucgagcgguucgagaucuucccgaaggaguccagcuggcccaaccacacgaucaccgggguguccgccagcugcucccacaacggcaagcgcagcuucuaccggaaccugcuguggcucaccgggaagaacggccuguaccccaaccuguccaagagcuacgccaacaacaaggagaaggagguccucauccuguggggcgugcaccacccgcccaacaucggggaccagcgcacccuguaccacacggagaacgccuacguguccgucgugagcagccacuacucccggcgcuucacccccgagaucaccaagcggcccaaggugcgcgaccaggagggccggaucaacuacuacuggacccuccuggagcccggggacacgaucaucuucgaggccaacggcaaccugaucgcgccgugguacgccuucgcccucagccgcggguucggcuccggcaucaucaccagcaacgcccccauggacgagugcgacgccaagugccagacgccccagggggcgaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggugaacagcgucaucgagaagaugaacacgcaguucaccgccguggggaaggaguucuccaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggucaaggggcagcugaagaacaacgccaaggagaucggcaacgggugcuucgaguucuaccacaagugcaacaacgagugcauggaguccgugaagaacggcacguacgacuaccccaaguacagcgaggaguccaagcucaaccgcgagaagaucgacggcgugaagcuggacagcaugggggucuaccagauccuggcgaucuacuccaccguggccagcagccucauccugcuggugucccucggcgccaucagcuucuggaugugcuccaacgggagccugcagugccggaucugcaucuga

SEQ ID NO: 61497 - RNA, 1701 nt, Artificial Sequence
  derived and/or modified sequence opt1 from hemagglutinin__InfluenzaA__ABB86937
augaaggccauccugcucgugcugcuguacaccuucaccagcacgaacgccgacacccucugcaucggcuaccacgcgaacaacuccaccgacaccgucgacacggugcuggagaagaacgugaccgucacccacagcgugaaccugcucgaggacaagcacaacgggcgccugugcaagcugggcgggaucgcgccccuccaccugggcaagugcaacaucgccggguggcugcucggcaacccggagugcgagcugcuguucaccguguccagcugguccuacaucgucgagacgagcaacuccuacaacgggaccugcuaccccggcgacuucaucaacuacgaggagcuccgggagcagcugagcuccgugagcuccuucgagcgcuucgagaucuuccccaaggccagcuccuggcccaaccacgagaccaaccggggcgugaccgccgccugcccgcacgccgggacgaacagcuucuaccgcaaccugaucuggcucgucaagaagggcaacaccuaccccaagaucuccaagagcuacgugaacaacaaggggaaggaggugcugguccuguggggcauccaccaccccuccaccagcaacgaccagcagucccucuaccagaacgccgacaccuacguguucgugggccccagcaaguacaacaagaaguucaagccggagaucgccacgcggcccaagguccgcgaccaggcggggcggaugaacuacuacuggacccugguggagcccggcgacaccaucaccuucgaggccacggggaaccugguggucccccgcuacgccuucgccaugaaccggggcagcgaguccggcaucaucaucagcgacaccccggugcacgacugcaacacgaccugccagacccccaagggggccaucaacaccucccuccccuuccagaacgugcaccccgucaccaucggcgagugcccgaaguacgucaagagcacccgccugcggauggcgacggggcugcgcaacauccccuccauccagagccggggccucuucggggccaucgccggcuucaucgaggagggcuggaccgggaugaucgacggcugguacggguaccaccaccagaacggccagggguccggcuacgccgccgaccagaaguccacccagaacgcgaucgacggcaucaccaacaaggugaacagcgugaucgagaagaugaacacgcaguucaccgccguggggaaggaguucaaccaccuggagaagcgcaucgagaaccugaacaagaaggucgacgacggcuuccucgacguguggaccuacaacgccgagcugcuggugcuccuggagaacgagcggacccuggacuuccacgacagcaacgucaagaaccucuacgagaaggugcgccggcagcugaagaacaacgccaaggagaucgggaacggcugcuucgaguucuaccacaagugcgacgacgccugcauggaguccgugaagaacgggacguacgacuaccccaaguacagcgaggagucccgccugaaccgggaggagaucaacggcaucaagcucgacagcacccgcaucuaccagauccuggcgaucuacuccaccgucgccagcuccagcgugcugcucgugucccugggcgccaucagcuucuggaugugcagcaacgggucccugcagugccggaucugcaucuga

SEQ ID NO: 61498 - RNA, 1701 nt, Artificial Sequence
  derived and/or modified sequence opt1 from hemagglutinin__InfluenzaA__ABB86946
augaaggccauccugcucgugcugcuguacaccuucaccgccgcgaacgccgacacgcucugcaucggcuaccacgccaacaacagcaccgacaccgucgacaccgugcuggagaagaacgugacggucacccacuccgugaaccugcucgaggaccgccacaacgggaagcugugcaagcugcggggcaucgcgccccuccaccuggggaagugcaacaucgccggcuggcugcucgggaacccggagugcgagagccuguccaccgugagcuccuggagcuacaucgucgagaccuccaacagcgacaacggcacgugcuaccccggcgacuucaucaacuacgaggagcugcgcgagcagcucuccagcguguccagcuucgagcgguucgagaucuuccccaaggccuccagcuggcccaaccacgagaccaaccgcgggaccaccgccgccugcccguacgccggcgcgaacuccuucuaccggaaccugaucuggcuggugaagaaggggaacagcuaccccaagcucaacaaguccuacgucaacaacaagggcaaggaggugcuggugcugugggggauccaccaccccagcacguccaacgagcagcagagccucuaccagaacgccgacaccuacgucuucgugggcagcuccaaguacaacaagaaguucaagcccgagaucgccacccgcccgaaggugcgggaccaggccggccgcaugaacuacuacuggacccugaucgagcccggggacacgaucaccuucgaggccaccggcaaccuggucgugccccgguacgcguucgccaugaaccgcgggagcggcuccggcaucaucaucagcgacacccccgugcacgacugcaacacgaccugccagaccccgaagggggccaucaacaccucccuccccuuccagaacguccaccccgugacgaucggcgagugccccaaguacgucaagagcaccaagcugcggauggccaccgggcugcgcaacaucccguccauccagagccggggccucuucggggccaucgcgggcuucaucgagggcggguggaccggcaugaucgacgggugguacggcuaccaccaccagaacgagcagggguccggcuacgccgccgaccagaaguccacgcagaacgccaucgacggcaucaccaacaaggugaacagcgugaucgagaagaugaacacccaguucaccgccguggggaaggaguucaaccaccuggagaagcgcaucgagaaccugaacaagaaggucgacgacggcuuccucgacguguggacguacaacgcggagcugcugguccuccuggagaacgagcggacccuggacuuccacgacagcaacgugaagaaccucuacgagaaggugcgcucccagcugaagaacaacgccaaggagaucgggaacggcugcuucgaguucuaccacaagugcgacgacgccugcauggagagcgucaagaacgggaccuacgacuaccccaaguacuccgaggagagccggcugaaccgcgaggagaucgacggcaucaagcucgacuccacccggaucuaccagauccuggccaucuacagcacgguggccuccagcagcgugcugcucgucucccugggcgcgaucagcuucuggaugugcuccaacgggagccugcagugccgcaucugcaucuga

SEQ ID NO: 61499 - RNA, 1701 nt, Artificial Sequence
  derived and/or modified sequence opt1 from hemagglutinin__InfluenzaA__ABB96319
augaagaccaucaucgcccugagcuacaucuucugccagguguucgcccagaaccuccccggcaacgacaacuccaccgcgacgcugugccuggggcaccacgccgucccgaacggcacccucgugaagaccaucaccaacgaccagaucgaggugacgaacgccaccgagcugguccagagcuccagcaccgggcgcaucugcgacaacccccaccggauccuggacggcaagaacugcacccucaucgacgcccugcugggggacccccacugcgacggcuuccagaacgagaagugggaccucuucguggagcgcuccaaggccuucagcaacugcuaccccuacgacgugccggacuacgcgucccugcggagccuggucgccuccagcggcacgcucgaguucuucaacgagggguucaacuggaccggcgugacccagaacgggggcuccuacgccugcaagcgcgggcccgacaacagcuucuucucccggcugaacuggcuguacaagagcgaguccaccuaccccgugcucaacgucacgaugcccaacaacgacaacuucgacaagcuguacaucuggggcgugcaccacccgagcaccgacaaggagcagaccaaccuguacgugcaggccuccggccgcgucaccgugagcacgaagcggucccagcagaccaucauccccaacguggggccccgccccuggguccggggccucagcagccgcaucuccaucuacuggaccaucgugaagccgggggacgugcugcugaucaacagcaacggcaaccucaucgcgccccggggcuacuucaagauccgcaccgggaaguccagcaucaugcgguccgacgcccccaucggcacgugcagcuccgagugcaucacccccaacgggagcaucccgaacgacaagcccuuccagaacgucaacaagaucaccuacggcgccugccccaaguacgugaagcagaacacccugaagcuggccacggggaugcgcaacgugcccgagaagcagacccggggcaucuucggcgccaucgcgggguucaucgagaacggcugggaggggaugaucgacggcugguacggguuccgccaccagaacuccgagggcaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccucuggagcuacaacgcggagcugcuggucgcccucgagaaccagcacaccaucgaccugaccgacuccgagaugaacaagcuguucgagaagacgcggcgccagcuccgggagaacgccgaggacauggggaacggcugcuucaagaucuaccacaagugcgacaacgccugcaucgggagcauccgcaacggcaccuacgaccacgacguguaccgcgacgaggcccugaacaaccgguuccagaucaagggcgucgagcugaaguccggguacaaggacuggauccucuggaucagcuucgcgaucuccugcuuccugcugugcguggugcuccugggcuucaucaugugggccugccagaaggggaacauccgcugcaacaucugcaucuga

SEQ ID NO: 61500 - RNA, 1701 nt, Artificial Sequence
  derived and/or modified sequence opt1 from hemagglutinin__InfluenzaA__ABB96330
augaagaccaucaucgcccugagcuacaucuucugccagguguucgcccagaaccuccccggcaacgacaacuccaccgcgacgcugugccuggggcaccacgccgucccgaacggcacccucgugaagaccaucaccaacgaccagaucgaggugacgaacgccaccgagcugguccagagcuccagcaccgggcgcaucugcgacaacccccaccggauccuggacggcaagaacugcacccucaucgacgcccugcugggggacccccacugcgacggcuuccagaacgagaagugggaccucuucguggagcgcuccaaggccuucagcaacugcuaccccuacgacgugccggacuacgcgucccugcggagccuggucgccuccagcggcacgcucgaguucuucaacgagggguucaacuggaccggcgugacccagaacgggggcuccuacgccugcaagcgcgggcccgacaacagcuucuucucccggcugaacuggcuguacaagagcgaguccaccuaccccgugcucaacgucacgaugcccaacaacgacaacuucgacaagcuguacaucuggggcgugcaccacccgagcaccgacaaggagcagaccaaccuguacgugcaggccuccggccgcgucaccgugagcacgaagcggucccagcagaccaucauccccaacguggggagccgccccuggguccggggccucagcucccgcaucagcaucuacuggaccaucgugaagcccggggacgugcugcugaucaacuccaacggcaaccucaucgcgccgcggggcuacuucaagauccgcaccggcaagagcuccaucaugcggagcgacgcccccaucgggacgugcuccagcgagugcaucacccccaacggguccauccccaacgaccgcccguuccagaacgucaacaagaucaccuacggcgccugccccaaguacgugaagcagaacacccugaagcuggccacggggaugcggaacgugcccgagaagcagacccgcggcaucuucggcgccaucgcgggguucaucgagaacggcugggaggggauggucgacggcugguacggguuccggcaccagaacagcgagggcaccggccaggccgccgaccucaaguccacccaggccgccaucgaccagaucaacgggaagcugaaccgcgugaucgagaagacgaacgagaaguuccaccagaucgagaaggaguucagcgagguggagggccggauccagaaccuggagaaguacgucgaggacaccaagaucgaccucugguccuacaacgcggagcugcugguggcccucgagaaccagcacaccaucgaccugaccgacagcgagaugaacaagcuguucgagaagacgcgccggcagcuccgcgagaacgccgaggacauggggaacggcugcuucaagaucuaccacaagugcgacaacgccugcaucggguccauccgcaacggcaccuacgaccacgacgucuaccgggacgaggcccugaacaaccgcuuccagaucaagggcguggagcucaagagcggguacaaggacuggauccuguggaucuccuucgcgaucagcugcuuccugcugugcgugguccuccugggcuucaucaugugggccugccagaaggggaacauccggugcaacaucugcaucuga

SEQ ID NO: 61501 - RNA, 1701 nt, Artificial Sequence
  derived and/or modified sequence opt1 from hemagglutinin__InfluenzaA__ABB96341
augaagaccaucaucgcccugagcuacaucuucugccagguguucgcccagaaccuccccggcaacgacaacuccaccgcgacgcugugccuggggcaccacgccgucccgaacggcacccucgugaagaccaucaccaacgaccagaucgaggugacgaacgccaccgagcugguccagagcuccagcaccgggcgcaucugcgacaacccccaccggauccuggacggcaagaacugcacccucaucgacgcccugcugggggacccccacugcgacggcuuccagaacgagaagugggaccucuucguggagcgcuccaaggccuucagcaacugcuaccccuacgacgugccggacuacgcgucccugcggagccuggucgccuccagcggcacgcucgaguucuucaacgagggguucaacuggaccggcgugacccagaacgggggcuccuacgccugcaagaaggggcccgacaacagcuucuucucccgccugaacuggcuguacaagagcgaguccaccuaccccgugcucaacgucacgaugcccaacaacgacaacuucgacaagcuguacaucuggggcgugcaccacccgagcaccgacaaggagcagaccaaccuguacgugcaggccuccggccgggucaccgugagcacgaagcgcucccagcagaccaucauccccaacguggggagccggcccuggguccgcggccucagcucccggaucagcaucuacuggaccaucgugaagcccggggacgugcugcugaucaacuccaacggcaaccucaucgcgccgcgcggcuacuucaagauccggaccggcaagagcuccaucaugcgcagcgacgcccccaucgggacgugcuccagcgagugcaucacccccaacggguccauccccaacgacaagccguuccagaacgucaacaagaucaccuacggcgccugccccaaguacgugaagcagaacacccugaagcuggccacggggaugcggaacgugcccgagaagcagacccgcggcaucuucggcgccaucgcgggguucaucgagaacggcugggaggggaugaucgacggcugguacggguuccggcaccagaacagcgagggcaccggccaggccgccgaccucaaguccacccaggccgccaucgaccagaucaacgggaagcugaaccgcgucaucgagaagacgaacgagaaguuccaccagaucgagaaggaguucagcgagguggagggccggauccaggaccuggagaaguacguggaggacaccaagaucgaccucugguccuacaacgcggagcugcuggucgcccucgagaaccagcacaccaucgaccugaccgacagcgagaugaacaagcuguucgagaagacgcgccggcagcuccgcgagaacgccgaggacauggggaacggcugcuucaagaucuaccacaagugcgacaacgccugcaucggguccauccggaacggcaccuacgaccacgacguguaccgcgacgaggcccugaacaaccgcuuccagaucaagggcgucgagcucaagagcggguacaaggacuggauccuguggaucuccuucgcgaucagcugcuuccugcugugcguggugcuccugggcuucaucaugugggccugccagaaggggaacauccggugcaacaucugcaucuga

SEQ ID NO: 61502 - RNA, 1701 nt, Artificial Sequence
  derived and/or modified sequence opt1 from hemagglutinin__InfluenzaA__ABB96395
augaagaccaucaucgcccugagcuacaucuucugccagguguucgcccagaaccuccccggcaacgacaacuccaccgcgacgcugugccuggggcaccacgccgucccgaacggcacccucgugaagaccaucaccaacgaccagaucgaggugacgaacgccaccgagcugguccagagcuccagcaccgggcgcaucugcgacagcccccaccggauccuggacggcaagaacugcacccucauggacgcccugcugggggacccccacugcgacggcuuccagaacgagaagugggaccucuucguggagcgcuccaaggccuucuccaacugcuaccccuacgacgugccggacuacgcgagccugcggucccuggucgccagcuccggcacgcucgaguucaucaacgagggguucaacuggaccggcgugacccagaacgggggcagcuacgccugcaagcgcgggcccgacaacuccuucuucagccggcugaacuggcuguacaaguccgagagcaccuaccccgugcucaacgucacgaugcccaacaacgacaacuucgacaagcuguacaucuggggcgugcaccacccguccaccgacaaggagcagaccaaccuguacgugcaggccagcggccgcgucaccguguccacgaagcggagccagcagaccaucauccccaacguggggagccgccccuggguccggggccucuccagccgcaucuccaucuacuggaccaucgugaagcccggggacauccugcugaucaacagcaacggcaaccucaucgcgccgcggggcuacuucaagauccgcaccgggaaguccagcaucaugcgguccgacgcccccaucggcacgugcagcuccgagugcaucacccccaacgggagcauccccaacgacaagccguuccagaacgugaacaagaucaccuacggcgccugccccaaguacgucaagcagaacacccugaagcuggccacggggaugcgcaacgugcccgagaagcagacccggggcaucuucggcgccaucgcgggguucaucgagaacggcugggaggggaugaucgacggcugguacggguuccgccaccagaacuccgagggcaccggccaggccgccgaccucaagagcacccaggccgccaucgaccagaucaacgggaagcugaaccgggugaucgagcgcacgaacgagaaguuccaccagaucgagaaggaguucuccgaggucgagggccggauccaggaccuggagaaguacguggaggacaccaagaucgaccucuggagcuacaacgcggagcugcugguggcccucgagaaccagcacaccaucgaccugaccgacuccgagaugaacaagcuguucgagaagacgcgccggcagcuccgcgagaacgccgaggacauggggaacggcugcuucaagaucuaccacaagugcgacaacgccugcaucgggagcauccgcaacggcaccuacgaccacgacgucuaccgggacgaggcccugaacaaccgcuuccagaucaagggcguggagcugaaguccggguacaaggacuggauccucuggaucagcuucgcgaucuccugcuuccugcugugcgucgugcuccugggcuucaucaugugggccugccagaaggggaacauccggugcaacaucugcaucuga

SEQ ID NO: 61503 - RNA, 1698 nt, Artificial Sequence
  derived and/or modified sequence opt1 from hemagglutinin__InfluenzaA__ABB96487
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaagaaguccagcuggcccaaccacacggugaccggggucuccgccagcugcucccacgacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucagcguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagagcaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcaucugcaucuga

SEQ ID NO: 61504 - RNA, 1701 nt, Artificial Sequence
  derived and/or modified sequence opt1 from hemagglutinin__InfluenzaA__ABB96520
augaagaccaucaucgcccugagcuacaucuucugccucgcccugggccaggaccugcccgggaacggcaacuccaccgcgacgcucugccuggggcaccacgccgugccgaacggcacccuggucaagaccaucaccgacgaccagaucgaggugacgaacgccaccgagcucgugcagagcuccagcaccgggaagaucugcaacaacccccaccgcauccuggacggcaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcgggacccuggaguucaucaccgagggcuucaccuggacgggggugacccagaacggcggguccaacgccugcaagcggggccccggcagcggguucuucucccgccucaacuggcugaccaagagcggcuccaccuaccccgugcugaacgucacgaugcccaacaacgacaacuucgacaagcucuacaucuggggcgugcaccacccgagcaccgaccaggagcagaccucccuguacgugcaggccagcgggcgggucaccguguccacgcgccggagccagcagaccaucauccccaacaucggcagccgccccugggugcgggggcuguccagccgcaucuccaucuacuggaccaucgucaagcccggcgacgugcucgugaucaacagcaacgggaaccugaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggcgccugccccaaguacgugaagcagaagacccugaagcucgccacggggaugcgcaacauccccgagaagaagacccggggcaucuucggggccaucgcgggcuucaucgagaacgggugggagggcaugaucgacggcugguacggguuccgccaccagaacagcgagggcaccgggcaggccgccgaccugaaguccacccaggccgccaucgaccagaucaacggcaagcugaaccgggugaucgagaagacgaacgagaaguuccaccagaucgagaaggaguucagcgaggucgaggggcgcauccaggaccucgagaaguacguggaggacaccaagaucgaccugugguccuacaacgcggagcugcucguggcccuggagaaccagcacaccaucgaccugaccgacagcgagaugaacaagcuguucgagaagacgcggcgccagcuccgggagaacgccgaggacaugggcaacggcugcuucaagaucuaccacaagugcgacaacgccugcaucgaguccauccgcaacgggaccuacgaccacgacgucuaccgcgacgaggcccugaacaaccgguuccagaucaagggcguggagcucaagagcggguacaaggacuggauccuguggaucuccuucgcgaucagcugcuuccugcucugcgucgugcugcugggcuucaucaugugggccugccagcgcggcaacauccggugcaacaucugcaucuga

SEQ ID NO: 61505 - RNA, 1701 nt, Artificial Sequence
  derived and/or modified sequence opt1 from hemagglutinin__InfluenzaA__ABB96531
augaagaccaucaucgcccugagcuacauccucugccugguguccgcccagaagauccccggcaacgacagcuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaacaacgagagcuucaacuggaccgggguggcccagaacggcaccuccuacgccugcaagcgccggagcaucaaguccuucuucagccgccugaacuggcuccaccagcugaaguacaaguaccccgcgcugaacgugaccaugcccaacaacgacaaguucgacaagcucuacaucuggggcguccaccaccccuccacggacagcgaccagaccagccuguacgcccaggccuccgggcgggugaccgugagcaccaagcgcucccagcagacggucaucccgaacaucgggagccggcccugggugcgcggcguguccagccggaucuccaucuacuggaccaucgucaagcccggcgacauccugcucaucaacagcaccgggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcucaagagcggguacaaggacuggauccuguggaucuccuucgccaucagcugcuuccugcugugcgugguccugcucggcuucaucaugugggccugccagaagggcaacauccggugcaacaucugcaucuga

SEQ ID NO: 61506 - RNA, 1701 nt, Artificial Sequence
  derived and/or modified sequence opt1 from hemagglutinin__InfluenzaA__ABC02234
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccuacgccugcaagcgccggagcaucaaguccuucuucagccgccucaacuggcugcaccagcugaaguacaaguaccccgcgcucaacgugaccaugcccaacaacgacaaguucgacaagcuguacaucuggggcguccaccaccccuccacggacagcgaccagaccucccuguacgcccaggccagcgggcgggugaccgugagcaccaagaucucccagcagacggucaucccgaacaucgggagccgccccugggugcggggcguguccagccgcaucuccaucuacuggaccaucgucaagcccggcgacauccuccugaucaacagcaccgggaaccugaucgcgccccggggcuacuucaagauccgcuccgggaaguccuccaucaugcggagcgacgccccgaucggcaagugcaacuccgagugcaucacccccaacggcagcauccccaacgacaagcccuuccagaacgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacuccgaggggacgggccaggccgcggaccucaagagcacccaggccgccaucaaccagaucaacgggaagcugaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgguuccagaucaagggcgucgagcugaaguccggguacaaggacuggauccucuggaucagcuucgccaugagcugcuuccuguucugcgugguccugcucggcuucaucaugugggccugccagaagggcaacauccgcugcaacaucugcaucuga

SEQ ID NO: 61507 - RNA, 1701 nt, Artificial Sequence
  derived and/or modified sequence opt1 from hemagglutinin__InfluenzaA__ABC02255
augaagaccaucaucgcccugagcuacaucuucugccucgugcuggcccaggaccugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggaagaucugcaacaacccccaccgcauccuggacggcaucaacugcacccugaucgacgcccuccugggggacccccacugcgacggcuuccagaacgagaagugggaccuguucguggagcgguccaaggccuucagcaacugcuaccccuacgacgugccggacuacgcgucccuccgcagccuggucgccuccagcggcacgcuggaguucaucaacgagggguucaacuggaccggcgugacccagaacgggggcuccaacgccugcaagcgggggcccgacagcggcuucuucucccgccucaacuggcuguacaagagcggcuccaccuaccccgugcugaacgucacgaugcccaacaacgacaacuucgacaagcucuacaucuggggcgugcaccacccgagcaccgaccaggagcagaccaaccuguacgugcaggccuccgggcgggucaccgugagcacgaagcgcucccagcagaccaucauccccaacguggggagccggcccuggguccgcggccugagcucccggaucagcaucuacuggaccaucgugaagcccggcgacauccucgugaucaacuccaacgggaaccugaucgcgccgcgcggccacuucaagaugcggaccggcaagagcuccaucaugcgcagcgacgcccccaucgggacgugcuccagcgagugcaucacccccaacggguccauccccaacgacaagccguuccagaacgucaacaagaucaccuacggcgccugccccaaguacgugaagcagaacacccugaagcucgccacgggcaugcggaacgugcccgagaagcagacccgcgggaucuucggcgccaucgcgggguucaucgagaacggcugggaggggaugaucgacggcugguacggcuuccggcaccagaacagcgaggggaccggccaggccgccgaccugaaguccacccaggccgccaucgaccagaucaacgggaagcugaaccgcgucaucgagaagacgaacgagaaguuccaccagaucgagaaggaguucagcgagguggagggccggauccaggaccucgagaaguacguggaggacaccaagaucgaccugugguccuacaacgcggagcugcucgucgcccuggagaaccagcacaccaucgaccugaccgacagcgagaugaacaagcuguucgagaagacgcgccggcagcuccgcgagaacgccgaggacauggggaacggcugcuucaagaucuaccacaagugcgacaacgccugcaucggcuccauccggaacgggaccuacgaccacgacguguaccgcgacgaggcccugaacaaccgcuuccagaucaagggcgucgagcucaagagcggguacaaggacuggauccuguggaucuccuucgcgaucagcugcuuccugcucugcguggugcugcugggcuucaucaugugggccugccagaagggcaacauccggugcaacaucugcaucuga

SEQ ID NO: 61508 - RNA, 1701 nt, Artificial Sequence
  derived and/or modified sequence opt1 from hemagglutinin__InfluenzaA__ABC02266
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcucccgggccugcaagcgcgggcccgacaacggcuucuucagccggcugaacuggcucuacaaguccggcagcaccuaccccgugcagaacgucacgaugcccaacaacgacaacuccgacaagcuguacaucuggggcgugcaccacccgagcaccgacaaggagcagaccgaccuguacgugcaggccuccgggaaggucaccgugagcacgaagcgcucccagcagaccgugauccccaacgucgggagccggcccugggugcgcggccucagcucccgggugagcaucuacuggaccaucgucaagcccggcgacauccuggugaucaacuccaacgggaaccugaucgcgccgcgcggcuacuucaagaugcggaccggcaagagcuccaucaugcgcagcgacgcccccaucgggacgugcuccagcgagugcaucacccccaacggguccauccccaacgacaagccguuccagaacgugaacaagaucaccuacggcgccugccccaaguacgucaagcagaacacccucaagcuggccacgggcaugcggaacgugcccgagaagcagacccgcgggaucuucggcgccaucgcgggguucaucgagaacggcugggaggggaugaucgacggcugguacggcuuccggcaccagaacagcgaggggaccggccaggccgccgaccugaaguccacccaggccgccaucgaccagaucaacgggaagcucaaccgcgugaucgagaagacgaacgagaaguuccaccagaucgagaaggaguucagcgaggucgagggccggauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcgccggcagcugcgcgagaacgccgaggacauggggaacggcugcuucaagaucuaccacaagugcgacaacgccugcaucggcuccauccggaacgggaccuacgaccacgacguguaccgcgacgaggcccucaacaaccgcuuccagaucaagggcguggagcucaagagcggguacaaggacuggauccuguggaucuccuucgcgaucagcugcuuccugcugugcgucgugcugcucggcuucaucaugugggccugccagaagggcaacauccggugcaacaucugcaucuga

SEQ ID NO: 61509 - RNA, 1701 nt, Artificial Sequence
  derived and/or modified sequence opt1 from hemagglutinin__InfluenzaA__ABC02288
augaagaccaucaucgcccugagcuacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaacaacgagagcuucaacuggaccgggguggcccagaacggcaccuccuacgccugcaagcgccggagcaucaaguccuucuucagccgccugaacuggcuccaccagcugaaguacaaguaccccgcgcugaacgugaccaugcccaacaacgacaaguucgacaagcucuacaucuggggcguccaccaccccuccacggacagcgaccagaccucccuguacgcccaggccagcgggcgggugaccgugagcaccaagcgcucccagcagacggucaucccgaacaucgggagccggcccugggugcgcggcguguccagccggaucuccaucuacuggaccaucgucaagcccggcgacauccugcucaucaacagcaccgggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcgucgagcugaaguccgggcacaaggacuggauccuguggaucagcuucgccaucagcugcuuccuccugugcgugguccugcucggcuucaucaugugggccugccagaagggcaacauccggugcaacaucugcaucuga

SEQ ID NO: 61510 - RNA, 1701 nt, Artificial Sequence; identical to SEQ ID NO: 61478
  derived and/or modified sequence opt1 from hemagglutinin__InfluenzaA__ABC02299

SEQ ID NO: 61511 - RNA, 1701 nt, Artificial Sequence; identical to SEQ ID NO: 61502
  derived and/or modified sequence opt1 from hemagglutinin__InfluenzaA__ABC02310

SEQ ID NO: 61512 - RNA, 1701 nt, Artificial Sequence; identical to SEQ ID NO: 61507
  derived and/or modified sequence opt1 from hemagglutinin__InfluenzaA__ABC02321

SEQ ID NO: 61513 - RNA, 1701 nt, Artificial Sequence; identical to SEQ ID NO: 61313
  derived and/or modified sequence opt1 from hemagglutinin__InfluenzaA__ABC02332

SEQ ID NO: 61514 - RNA, 1701 nt, Artificial Sequence
  derived and/or modified sequence opt1 from hemagglutinin__InfluenzaA__ABC39805
augaagaccaucaucgcccugagcuacauccucugccugguguucgcccagaaccugcccggcaacgacaacuccaccgcgacgcucugccuggggcaccacgccgucccgaacggcacccuggugaagaccaucaccaacgaccagaucgaggugacgaacgccaccgagcucguccagagcuccagcgccgggcgcaucugcgacagcccccaccggauccuggacggcaagaacugcacccugaucgacgcccuccugggggacccccacugcgacggcuuccagaacgagaagugggaccuguucguggagcgcagcaaggcguucuccaacugcuaccccuacgacgugcaggacuacgccagccuccggucccuggucgccagcuccggcacccuggaguucaucaacgagggguucaacuggacgggcgugacccagagcgggggcuccuacgccugcaagcgcgggagcggcaacuccuucuucagccggcucaacuggcuguacaaguccgagagcaaguacccggcgcugaacgugaccaugcccaacaacggcaacuucgacaagcucuacaucuggggcguccaccaccccuccaccgacaaggagcagacgaaccuguacgugcgcgccagcggccgggugaccgucagcaccaagcgcucccagcagaccgugauccccaacaucgggccgcggcccugggugcgcggccugagcucccggaucagcaucuacuggacgaucgucaagcccggcgacauccuccugaucaacuccagcgggaaccugaucgcgccccgcggcuacuucaagauccggaccgggaaguccagcaucaugcgcuccgacgccccgaucgggaccugcagcuccgagugcaucacccccaacgggagcauccccaacgacaagcccuuccagaacgugaacaagaucacguacggcgccugcccgaaguacgugaagcagaacacccucaagcuggccaccggcaugcggaacauccccgagaagcagacccgcgggaucuucggcgccaucgccggguucaucgagaacggcugggaggggauggucgacggcugguacggcuuccggcaccagaacuccgaggggacgggccaggccgccgaccugaaguccacccaggcggccaucgaccagaucaacgggaagcucaaccgcgugaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagacccgccggcagcugcgcgagaacgccgaggacauggggaacggcugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggguacaaggacuggauccuguggaucagcuucgccaucagcugcuuccuccugugcgugguccugcucggcuucaucaugugggccugccagaagggcaacauccggugcaacaucugcaucuga

SEQ ID NO: 61515 - RNA, 1698 nt, Artificial Sequence
  derived and/or modified sequence opt1 from hemagglutinin__InfluenzaA__ABC40522
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagagcuccuucuacaagaaccugcuguggcucaccgggaagaacggccuguaccccaaccugagcaaguccuacgccaacaacaaggagaaggaggugcucauccuguggggcgugcaccacccgcccaacaucggggaccagcgcacccuguaccacacggagaacgccuacgucagcguggugagcucccacuacagccggcgcuucacccccgagaucaccaagcggcccaagguccgcgaccaggagggccggaucaacuacuacuggacccuccuggagcccggggacacgaucaucuucgaggccaacggcaaccugaucgcgccgugguacgccuucgcccucucccgcggguucggcagcggcaucaucaccuccaacgcccccauggacgagugcgacgccaagugccagacgccccagggggcgaucaacagcucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagagcaagcucaaccgcgagaagaucgacggcgucaagcuggacuccaugggcguguaccagauccuggcgaucuacagcaccguggccagcucccucguccugcuggugagccucggggccaucuccuucuggaugugcagcaacggcucccugcagugccggaucugcaucuga

SEQ ID NO: 61516 - RNA, 1698 nt, Artificial Sequence; identical to SEQ ID NO: 61304
  derived and/or modified sequence opt1 from hemagglutinin__InfluenzaA__ABC40533

SEQ ID NO: 61517 - RNA, 1701 nt, Artificial Sequence
  derived and/or modified sequence opt1 from hemagglutinin__InfluenzaA__ABC40555
augaagaccaucaucgcccugagcuacaucuucugccucguguucgcccagaaccugccccgcaacgacaaguccaccgcgacgcugugccucggccaccacgccgucccgaacgggacccuggugaagaccaucaccaacgaccagaucgaggugacgaacgccaccgagcugguccagagcuccagcaccggccggaucugcgacagcccccaccgcauccucgacgggaagaacugcacccugguggacgcccugcucggcgacccccacugcgacggguuccagaacgagaagugggaccuguucguggagcgguccaaggccuucuccaacugcuaccccuacgacgucccggacuacgcgagccugcgcucccucguggccagcuccggcacgcuggaguucaucaacgagagcuucaacuggaccggcgugacccaguccgggggcagcuacgccugcaagcggggguccgacaacagcuucuucucccgccugaacuggcucuacgagagcgaguccaaguaccccguccugaacgugaccaugcccaacaacggcaacuucgacaagcuguacaucuggggcgugcaccaccccagcacggacaaggagcagaccaaccucuacguccgggccagcgggcgcgugaccguguccaccaagcggagccagcagacgaucaucccgaacaucggcucccgccccuggguccgggggcugagcucccgcaucagcaucuacuggaccaucgugaagcccggcgacauccugcucaucaacuccaacgggaaccugaucgcgccccggggcuacuucaagauccgcaccggcaagagcuccaucaugcggagcgacgccccgaucgggaccugcuccagcgagugcaucacgcccaacggcuccauccccaacgacaagcccuuccagaacgugaacaagaucaccuacggggccugcccgaaguacgucaagcagaacacccugaagcucgccaccggcaugcgcaacgugcccgagaagcagacgcgggggaucuucggcgccaucgcgggcuucaucgagaacgggugggagggcaugguggacgggugguacggcuuccgccaccagaacagcgaggggaccggccaggccgccgaccugaaguccacccaggccgccaucgaccagaucaacggcaagcugaaccgggucaucgagaagaccaacgagaaguuccaccagaucgagaaggaguucagcgagguggaggggcgcauccaggaccucgagaaguacguggaggacacgaagaucgaccugugguccuacaacgcggagcugcucgucgcccuggagaaccagcacaccaucgaccugaccgacagcgagaugaacaagcuguucgagaagacccggcgccagcuccgcgagaacgccgaggacaugggcaacgggugcuucaagaucuaccacaagugcgacaacgccugcaucggcuccauccggaacgggacguacgaccacgacguguaccgcgacgaggcccugaacaaccgguuccagaucaagggcgucgagcucaagagcggcuacaaggacuggauccuguggaucagcuucgcgaucuccugcuuccugcucugcguggugcugcugggguucaucaugugggccugccagaagggcaacauccgcugcaacaucugcaucuga

SEQ ID NO: 61518 - RNA, 1701 nt, Artificial Sequence
  derived and/or modified sequence opt1 from hemagglutinin__InfluenzaA__ABC40608
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccagcgccugcaagcgccgguccaucaagagcuucuucucccgccucaacuggcugcaccagcugaaguacaaguaccccgcgcucaacgugaccaugcccaacaacgacaaguucgacaagcuguacaucuggggcguccaccaccccagcacggacuccgaccagaccagccuguacgcccaggccagcgggcgggugaccguguccacccgccggagccagcagacggucaucccgaacaucgggucccgccccugggugcggggcgugagcucccgcaucagcaucuacuggaccaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagagcgugaaccgcaucacguacggggccugcccgcgguacgugaagcagaacacccucaagcuggccaccggcaugcgcaacguccccgagaagcagacccgggggaucuucggcgccaucgccggguucaucgagaacggcugggagggcaugguggacgggugguacggcuuccgccaccagaacuccgaggggacgggccaggccgcggaccugaaguccacccaggccgccaucaaccagaucaacgggaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacacgaucgaccugaccgacuccgagaugaacaagcuguucgagcgcacccggaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgguuccagaucaagggcgucgagcucaagagcggguacaaggacuggauccuguggaucuccuucgccaucagcugcuuccugcugugcgugguccuccugggcuucaucaugugggccugccagaagggcaacauccgcugcaacaucugcaucuga

SEQ ID NO: 61519 - RNA, 1701 nt, Artificial Sequence
  derived and/or modified sequence opt1 from hemagglutinin__InfluenzaA__ABC40619
augaagaccaucaucgcccugagcuacaucuucugccucgugcugggccaggacuucuccgggaacgacaacagcaccgccacgcugugccucggccaccacgcgguccccaacgggacccuggugaagaccaucaccaacgaccagaucgaggugacgaacgccaccgagcugguccaguccagcuccaccggcaagaucugcaacaacccgcaccgcauccucgacgggaucgacugcacccugaucgacgcccugcucggcgacccccacugcgacggcuuccagaacgagacgugggaccuguucguggagcggagcaaggccuucuccaacugcuaccccuacgacgugcccgacuacgccagccugcgcucccucgucgcgagcuccgggacccuggaguucaucaacgagggcuucaacuggaccggggugacccagaacggcgggagcaacgccugcaagcggggcccggacuccggcuucuucagccgccugaacuggcucuacaaguccgggagcacguaccccgugcugaacgucuccaugcccaacaacgacaacuucgacaagcuguacaucuggggcgugcaccaccccagcaccgaccaggagcagaccaaccucuacgugcaggccuccgggcgggucaccgugagcacgaagcgcagccagcagaccaucaucccgaacaucggcucccggcccugggugcgcggccugagcucccggaucagcaucuacuggaccaucgucaagcccggggacauccuggugaucaacuccaacggcaaccucaucgcgccccgcggguacuucaagaugcggaccggcaagagcuccaucaugcgcagcgacgccccgaucgggacgugcaucuccgagugcaucacccccaacggcagcauccccaacgacaagcccuuccagaacgugaacaagaucaccuacggcgccugcccgaaguacgucaagcagaacacccugaagcuggccacggggaugcggaacgugcccgagaagcagacccgcggcaucuucggggccaucgccggcuucaucgagaacgggugggagggcaugaucgacggcugguacggguuccggcaccagaacuccgagggcaccgggcaggcggccgaccucaagagcacccaggccgccaucgaccagaucaacggcaagcugaaccgcaucaucgagaagacgaacgagaaguuccaccagaucgagaaggaguucuccgagguggaggggcggauccaggaccuggagaaguacgucgaggacaccaagaucgaccucuggagcuacaacgccgagcugcugguggcgcucgagaaccagcacaccaucgaccugaccgacuccgagaugaacaagcuguucgagaagacgcgccggcagcuccgcgagaacgccgaggacaugggcaacggcugcuucaagaucuaccacaagugcgacaacgccugcaucgggagcauccggaacggcaccuacgaccacgacguguaccgcgacgaggcccugaacaaccgcuuccagaucaagggggucgagcugaaguccggcuacaaggacuggauccucuggaucagcuucgccaucuccugcuuccugcugugcgugguccuccugggcuucaucaugugggcgugccagaaggggaacauccggugcaacaucugcaucuga

SEQ ID NO: 61520 - RNA, 1698 nt, Artificial Sequence
  derived and/or modified sequence opt1 from hemagglutinin__InfluenzaA__ABC40631
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacgcuguaccacaccgagaacgccuacgucagcguggugagcucccacuacagccgccgguucacccccgagaucaccaagcgccccaagguccgggaccaggagggccgcaucaacuacuacuggacgcuccuggagcccggggacaccaucaucuucgaggccaacggcaaccugaucgccccgugguacgcguucgcccucucccggggguucggcagcggcaucaucaccuccaacgcccccauggacgagugcgacgccaagugccagacgccccagggggccaucaacagcucccugcccuuccagaacgugcacccggugaccaucggcgagugccccaaguacguccgcagcgcgaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacccagaacgcgaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgccgagcugcucgugcugcuggagaacgagcgcacgcucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgucaagcuggaguccaugggcguguaccagauccuggccaucuacagcaccguggcgagcucccucguccugcuggugagccucggggccaucuccuucuggaugugcagcaacggcucccugcagugccgcaucugcaucuga

SEQ ID NO: 61521 - RNA, 1701 nt, Artificial Sequence
  derived and/or modified sequence opt1 from hemagglutinin__InfluenzaA__ABC41692
augaagaccaucaucgcccugagcuacauccucugccugguguucgcccagaagcccccgggcaacgacaacuccaccgcgacgcugugccucgggcaccacgccguccccaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuacccguacgacgugcccgaccacgcgagccugcggucccuggucgccagcuccgggacgcucgaguucaacaacgagagcuucgacuggaccggcgugacccagaacgggaccuccagcgccugcaagcgccgguccaacaagagcuucuucucccgccugaacuggcugacgcaccucaaguacaaguaccccgcccugaacgugaccaugcccaacaacgagaaguucgacaagcuguacaucuggggcguccaccacccggggaccgacagcgaccagaucucccucuacgcgcaggccagcggccggaucaccgugagcacgaagcgcucccagcagaccgugauccccaacaucggcagccggccccgcguccgggacguguccagccgcaucuccaucuacuggaccaucgugaagcccggggacauccugcugaucaacagcaccggcaaccucaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcuggcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagagcacccaggcggccaucaaccagaucaacggcaagcugaaccggcugaucggcaagaccaacgagaaguuccaccagaucgagaaggaguucuccgagguggaggggcgcauccaggaccucgagaaguacguggaggacacgaagaucgaccuguggagcuacaacgccgagcugcucgucgcccuggagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcguggagcucaaguccggcuacaaggacuggauccuguggaucagcuucgccaucagcugcuuccugcucugcgucgcccugcugggguucaucaugugggccugccagaagggcaacauccggugcaacaucugcaucuga

SEQ ID NO: 61522 - RNA, 1698 nt, Artificial Sequence; identical to SEQ ID NO: 61307
  derived and/or modified sequence opt1 from hemagglutinin__InfluenzaA__ABC41714

SEQ ID NO: 61523 - RNA, 1701 nt, Artificial Sequence
  derived and/or modified sequence opt1 from hemagglutinin__InfluenzaA__ABC41725
augaagaccaccaucgcccugagcuacauccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagagcuccagcaccgggggcaucugcgacagcccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacccuggaguucaacaacgagagcuucgacuggaccggcgugacccagaacgggacguccagcgccugcaagcgccgguccaacaagagcuucuucucccgccugaacuggcucacccaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucacggugagcaccaagcgcucccagcagaccgugaucccgaacaucggcagccggccccgcguccgggacguguccagccgcaucuccaucuacuggaccaucgugaagcccggggacauccugcucaucaacagcacgggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaaccgcaucaccuacggcgccugcccgcgguacgugaagcagaacacccugaagcucgccacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 61524 - RNA, 1701 nt, Artificial Sequence
  derived and/or modified sequence opt1 from hemagglutinin__InfluenzaA__ABC41736
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 61525 - RNA, 1701 nt, Artificial Sequence; identical to SEQ ID NO: 61524
  derived and/or modified sequence opt1 from hemagglutinin__InfluenzaA__ABC41952

SEQ ID NO: 61526 - RNA, 1701 nt, Artificial Sequence; identical to SEQ ID NO: 61524
  derived and/or modified sequence opt1 from hemagglutinin__InfluenzaA__ABC41953

SEQ ID NO: 61527 - RNA, 1701 nt, Artificial Sequence; identical to SEQ ID NO: 61524
  derived and/or modified sequence opt1 from hemagglutinin__InfluenzaA__ABC41964

SEQ ID NO: 61528 - RNA, 1701 nt, Artificial Sequence; identical to SEQ ID NO: 61524
  derived and/or modified sequence opt1 from hemagglutinin__InfluenzaA__ABC42014

SEQ ID NO: 61529 - RNA, 1701 nt, Artificial Sequence; identical to SEQ ID NO: 61524
  derived and/or modified sequence opt1 from hemagglutinin__InfluenzaA__ABC42114

SEQ ID NO: 61530 - RNA, 1701 nt, Artificial Sequence; identical to SEQ ID NO: 61524
  derived and/or modified sequence opt1 from hemagglutinin__InfluenzaA__ABC42125

SEQ ID NO: 61531 - RNA, 1701 nt, Artificial Sequence; identical to SEQ ID NO: 61524
  derived and/or modified sequence opt1 from hemagglutinin__InfluenzaA__ABC42136

SEQ ID NO: 61532 - RNA, 1701 nt, Artificial Sequence
  derived and/or modified sequence opt1 from hemagglutinin__InfluenzaA__ABC42147
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgucccgaucggcaagugcaacuccgagugcaucacgcccaacgggagcauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggacguacgaccacgacguguaccgggacgaggcgcucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 61533 - RNA, 1701 nt, Artificial Sequence; identical to SEQ ID NO: 61524
  derived and/or modified sequence opt1 from hemagglutinin__InfluenzaA__ABC42158

SEQ ID NO: 61534 - RNA, 1701 nt, Artificial Sequence; identical to SEQ ID NO: 61524
  derived and/or modified sequence opt1 from hemagglutinin__InfluenzaA__ABC42169

SEQ ID NO: 61535 - RNA, 1701 nt, Artificial Sequence; identical to SEQ ID NO: 61524
  derived and/or modified sequence opt1 from hemagglutinin__InfluenzaA__ABC42180

SEQ ID NO: 61536 - RNA, 1701 nt, Artificial Sequence; identical to SEQ ID NO: 61524
  derived and/or modified sequence opt1 from hemagglutinin__InfluenzaA__ABC42192

SEQ ID NO: 61537 - RNA, 1701 nt, Artificial Sequence; identical to SEQ ID NO: 61524
  derived and/or modified sequence opt1 from hemagglutinin__InfluenzaA__ABC42307

SEQ ID NO: 61538 - RNA, 1701 nt, Artificial Sequence
  derived and/or modified sequence opt1 from hemagglutinin__InfluenzaA__ABC42318
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggaccacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagagcacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgaguuccucgucgcccuggagaaccagcacaccaucgaccugaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcguggagcucaaguccggcuacaaggacuggauccuguggaucagcuucgccaucagcugcuuccugcucugcgucgcccugcugggguucaucaugugggccugccagaagggcaacauccggugcaacaucugcaucuga

SEQ ID NO: 61539 - RNA, 1701 nt, Artificial Sequence; identical to SEQ ID NO: 61524
  derived and/or modified sequence opt1 from hemagglutinin__InfluenzaA__ABC42346

SEQ ID NO: 61540 - RNA, 1701 nt, Artificial Sequence; identical to SEQ ID NO: 61524
  derived and/or modified sequence opt1 from hemagglutinin__InfluenzaA__ABC42461

SEQ ID NO: 61541 - RNA, 1701 nt, Artificial Sequence; identical to SEQ ID NO: 61524
  derived and/or modified sequence opt1 from hemagglutinin__InfluenzaA__ABC42494

SEQ ID NO: 61542 - RNA, 1701 nt, Artificial Sequence; identical to SEQ ID NO: 61524
  derived and/or modified sequence opt1 from hemagglutinin__InfluenzaA__ABC42505

SEQ ID NO: 61543 - RNA, 1701 nt, Artificial Sequence
  derived and/or modified sequence opt1 from hemagglutinin__InfluenzaA__ABC42516
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaacaagcucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggacguacgaccacgacguguaccgcgacgaggcccucaacaaccgguuccagaucaagggcguggagcugaaguccggcuacaaggacuggauccuguggaucagcuucgccaucagcugcuuccuccugugcgucgcccugcucggguucaucaugugggccugccagaagggcaacauccgcugcaacaucugcaucuga

SEQ ID NO: 61544 - RNA, 1701 nt, Artificial Sequence; identical to SEQ ID NO: 61524
  derived and/or modified sequence opt1 from hemagglutinin__InfluenzaA__ABC42527

SEQ ID NO: 61545 - RNA, 1701 nt, Artificial Sequence; identical to SEQ ID NO: 61524
  derived and/or modified sequence opt1 from hemagglutinin__InfluenzaA__ABC42574

SEQ ID NO: 61546 - RNA, 1701 nt, Artificial Sequence; identical to SEQ ID NO: 61524
  derived and/or modified sequence opt1 from hemagglutinin__InfluenzaA__ABC42585

SEQ ID NO: 61547 - RNA, 1701 nt, Artificial Sequence; identical to SEQ ID NO: 61251
  derived and/or modified sequence opt1 from hemagglutinin__InfluenzaA__ABC42596

SEQ ID NO: 61548 - RNA, 1701 nt, Artificial Sequence; identical to SEQ ID NO: 61290
  derived and/or modified sequence opt1 from hemagglutinin__InfluenzaA__ABC42607

SEQ ID NO: 61549 - RNA, 1701 nt, Artificial Sequence; identical to SEQ ID NO: 61290
  derived and/or modified sequence opt1 from hemagglutinin__InfluenzaA__ABC42618

SEQ ID NO: 61550 - RNA, 1701 nt, Artificial Sequence
  derived and/or modified sequence opt1 from hemagglutinin__InfluenzaA__ABC42629
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61551 - RNA, 1701 nt, Artificial Sequence
  derived and/or modified sequence opt1 from hemagglutinin__InfluenzaA__ABC42640
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccuggucgccagcuccgggacgcucgaguucaacaacgagagcuucaacuggaccggcgugacccagaacgggaccuccagcgccugcaagcgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccgacaacgaccagaucagccucuacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcugaucaacagcaccggcaaccucaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 61552 - RNA, 1701 nt, Artificial Sequence; identical to SEQ ID NO: 61251
  derived and/or modified sequence opt1 from hemagglutinin__InfluenzaA__ABC42651

SEQ ID NO: 61553 - RNA, 1701 nt, Artificial Sequence
  derived and/or modified sequence opt1 from hemagglutinin__InfluenzaA__ABC42662
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgaguuccucguggcccuggagaaccagcacacgaucgaccugaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 61554 - RNA, 1701 nt, Artificial Sequence
  derived and/or modified sequence opt1 from hemagglutinin__InfluenzaA__ABC42673
augaagaccaucaucgcccugagcuacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagagcuccagcaccgggggcaucugcgacagcccccaccagauccucgacggggagaacugcacccugaucgacgcccugcucggcgacccccagugcgacggcuuccagaacaagaagugggaccuguucgucgagcgcagcaaggccuacuccaacugcuaccccuacgacgugccggacuacgcgagccugcggucccucguggccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucagccuguacgcgcaggccuccggccggaucaccgucagcacgaagcgcagccagcagaccgugaucccgaacaucggcucccggccccgcgugcgggacauccccagccgcaucuccaucuacuggaccaucgucaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61555 - RNA, 1701 nt, Artificial Sequence; identical to SEQ ID NO: 61251
  derived and/or modified sequence opt1 from hemagglutinin__InfluenzaA__ABC42684

SEQ ID NO: 61556 - RNA, 1701 nt, Artificial Sequence; identical to SEQ ID NO: 61251
  derived and/or modified sequence opt1 from hemagglutinin__InfluenzaA__ABC42695

SEQ ID NO: 61557 - RNA, 1701 nt, Artificial Sequence
  derived and/or modified sequence opt1 from hemagglutinin__InfluenzaA__ABC42706
augaagaccaucaucgcccugagcuacauccucugccugguguucgcccagaagcugcccggcaacgacaacuccaccgcgacgcucugccuggggcaccacgccgucccgaacggcaccaccgugaagaccaucacgaacgaccagaucgaggugaccaacgccaccgagcugguccagagcuccagcaccgggggcaucugcgacagcccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacccuggaguucaacaacgagagcuucaacuggaccggcgugacccagaacgggacguccagcgccugcaagcgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucacggugagcaccaagcgcagccagcagaccgugaucccgaacaucggcucccggccccgcguccgggacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgugaaccgcaucaccuacggcgccugcccccgguacgucaagcagaacacccugaagcucgcgacggggaugcgcaacgugcccgagaagcagacccggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcgugguccugcucggguucaucaugugggccugccagaagggcaacauccggugcaacaucugcaucuga

SEQ ID NO: 61558 - RNA, 1701 nt, Artificial Sequence; identical to SEQ ID NO: 61251
  derived and/or modified sequence opt1 from hemagglutinin__InfluenzaA__ABC42717

SEQ ID NO: 61559 - RNA, 1701 nt, Artificial Sequence
  derived and/or modified sequence opt1 from hemagglutinin__InfluenzaA__ABC42728
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagagcuccagcaccgggggcaucugcgacagcccccaccagauccucgacggggagaacugcacccugauggacgcccugcucggcgacccccagugcgacggcuuccagaacaagaagugggaccuguucguggagcgcagccgggccuacuccaacugcuaccccuacgacgucccggacuacgcgagccugcgcucccucguggccagcuccgggacgcuggaguucaacaacgagagcuucaacuggaccggcgugacccagaacgggaccuccagcgccugcaagcggcgcuccaacaacagcuucuucucccggcugaacuggcucacgcaccugaaguucaaguaccccgcccugaacgucaccaugcccaacaacgagaaguucgacaagcucuacaucuggggcgugcaccaccccgggaccgacaacgaccagaucagccuguacgcgcaggccuccggccgcaucaccgugagcacgaagcggagccagcagaccgucaucccgaacaucggcucccgcccccgggugcgcgacauccccagccggaucuccaucuacuggaccaucgugaagcccggggacauccugcucaucaacagcaccggcaaccugaucgccccgcgcggguacuucaagauccgguccggcaagagcuccaucaugcgcagcgacgcccccaucggcaagugcaacuccgagugcaucacgcccaacgggagcauccccaacgacaagccguuccagaacgucaaccggaucaccuacggcgccugcccccgcuacgugaagcagaacacccugaagcucgcgaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucagcuucgccaucuccugcuuccuccugugcgucgugcugcucggguucaucaugugggccugccagaagggcaacauccgcugcaacaucugcaucuga

SEQ ID NO: 61560 - RNA, 1701 nt, Artificial Sequence; identical to SEQ ID NO: 61251
  derived and/or modified sequence opt1 from hemagglutinin__InfluenzaA__ABC42739

SEQ ID NO: 61561 - RNA, 1698 nt, Artificial Sequence
  derived and/or modified sequence opt1 from hemagglutinin__InfluenzaA__ABC42750
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 61562 - RNA, 1701 nt, Artificial Sequence; identical to SEQ ID NO: 61251
  derived and/or modified sequence opt1 from hemagglutinin__InfluenzaA__ABC42761

SEQ ID NO: 61563 - RNA, 1701 nt, Artificial Sequence
  derived and/or modified sequence opt1 from hemagglutinin__InfluenzaA__ABC42772
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaaguccguggagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 61564 - RNA, 1701 nt, Artificial Sequence; identical to SEQ ID NO: 61251
  derived and/or modified sequence opt1 from hemagglutinin__InfluenzaA__ABC42783

SEQ ID NO: 61565 - RNA, 1701 nt, Artificial Sequence; identical to SEQ ID NO: 61251
  derived and/or modified sequence opt1 from hemagglutinin__InfluenzaA__ABC42794

SEQ ID NO: 61566 - RNA, 1701 nt, Artificial Sequence; identical to SEQ ID NO: 61251
  derived and/or modified sequence opt1 from hemagglutinin__InfluenzaA__ABC42805

SEQ ID NO: 61567 - RNA, 1701 nt, Artificial Sequence; identical to SEQ ID NO: 61290
  derived and/or modified sequence opt1 from hemagglutinin__InfluenzaA__ABC42816

SEQ ID NO: 61568 - RNA, 1701 nt, Artificial Sequence
  derived and/or modified sequence opt1 from hemagglutinin__InfluenzaA__ABC42827
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcauguccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61569 - RNA, 1701 nt, Artificial Sequence; identical to SEQ ID NO: 61251
  derived and/or modified sequence opt1 from hemagglutinin__InfluenzaA__ABC42849

SEQ ID NO: 61570 - RNA, 1701 nt, Artificial Sequence
  derived and/or modified sequence opt1 from hemagglutinin__InfluenzaA__ABC42882
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucagcuucgccaucagcugcuuccugcugugcaucguccuccugggcuucaucaugugggccugccagaaggggaacauccggugcaacaucugcaucuga

SEQ ID NO: 61571 - RNA, 1701 nt, Artificial Sequence; identical to SEQ ID NO: 61570
  derived and/or modified sequence opt1 from hemagglutinin__InfluenzaA__ABC42893

SEQ ID NO: 61572 - RNA, 1701 nt, Artificial Sequence; identical to SEQ ID NO: 61524
  derived and/or modified sequence opt1 from hemagglutinin__InfluenzaA__ABC42929

SEQ ID NO: 61573 - RNA, 1701 nt, Artificial Sequence; identical to SEQ ID NO: 61524
  derived and/or modified sequence opt1 from hemagglutinin__InfluenzaA__ABC42940

SEQ ID NO: 61574 - RNA, 1701 nt, Artificial Sequence; identical to SEQ ID NO: 61524
  derived and/or modified sequence opt1 from hemagglutinin__InfluenzaA__ABC42951

SEQ ID NO: 61575 - RNA, 1701 nt, Artificial Sequence; identical to SEQ ID NO: 61524
  derived and/or modified sequence opt1 from hemagglutinin__InfluenzaA__ABC42962

SEQ ID NO: 61576 - RNA, 1701 nt, Artificial Sequence; identical to SEQ ID NO: 61524
  derived and/or modified sequence opt1 from hemagglutinin__InfluenzaA__ABC42973

SEQ ID NO: 61577 - RNA, 1701 nt, Artificial Sequence; identical to SEQ ID NO: 61524
  derived and/or modified sequence opt1 from hemagglutinin__InfluenzaA__ABC42995

SEQ ID NO: 61578 - RNA, 1701 nt, Artificial Sequence; identical to SEQ ID NO: 61524
  derived and/or modified sequence opt1 from hemagglutinin__InfluenzaA__ABC43006

SEQ ID NO: 61579 - RNA, 1701 nt, Artificial Sequence; identical to SEQ ID NO: 61524
  derived and/or modified sequence opt1 from hemagglutinin__InfluenzaA__ABC43028

SEQ ID NO: 61580 - RNA, 1701 nt, Artificial Sequence; identical to SEQ ID NO: 61524
  derived and/or modified sequence opt1 from hemagglutinin__InfluenzaA__ABC43039

SEQ ID NO: 61581 - RNA, 1701 nt, Artificial Sequence; identical to SEQ ID NO: 61524
  derived and/or modified sequence opt1 from hemagglutinin__InfluenzaA__ABC43050

SEQ ID NO: 61582 - RNA, 1701 nt, Artificial Sequence; identical to SEQ ID NO: 61524
  derived and/or modified sequence opt1 from hemagglutinin__InfluenzaA__ABC43061

SEQ ID NO: 61583 - RNA, 1701 nt, Artificial Sequence
  derived and/or modified sequence opt1 from hemagglutinin__InfluenzaA__ABC43072
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagaagaccaagaagcagcugcgggagaacgccgaggacaugggcaacgggugcuucaagaucuaccacaagugcgacaacgcgugcaucggcagcauccgcaacgggacguacgaccacgacguguaccgcgacgaggcccucaacaaccgguuccagaucaagggcguggagcugaaguccggcuacaaggacuggauccuguggaucagcuucaccaucagcugcuuccuccugugcgucgcccugcucggguucaucaugugggccugccagaagggcaacauccgcugcaacaucugcaucuga

SEQ ID NO: 61584 - RNA, 1701 nt, Artificial Sequence; identical to SEQ ID NO: 61524
  derived and/or modified sequence opt1 from hemagglutinin__InfluenzaA__ABC43083

SEQ ID NO: 61585 - RNA, 1701 nt, Artificial Sequence; identical to SEQ ID NO: 61524
  derived and/or modified sequence opt1 from hemagglutinin__InfluenzaA__ABC43094

SEQ ID NO: 61586 - RNA, 1701 nt, Artificial Sequence; identical to SEQ ID NO: 61524
  derived and/or modified sequence opt1 from hemagglutinin__InfluenzaA__ABC43116

SEQ ID NO: 61587 - RNA, 1701 nt, Artificial Sequence; identical to SEQ ID NO: 61251
  derived and/or modified sequence opt1 from hemagglutinin__InfluenzaA__ABC43127

SEQ ID NO: 61588 - RNA, 1701 nt, Artificial Sequence; identical to SEQ ID NO: 61290
  derived and/or modified sequence opt1 from hemagglutinin__InfluenzaA__ABC43138

SEQ ID NO: 61589 - RNA, 1701 nt, Artificial Sequence; identical to SEQ ID NO: 61251
  derived and/or modified sequence opt1 from hemagglutinin__InfluenzaA__ABC43149

SEQ ID NO: 61590 - RNA, 1701 nt, Artificial Sequence; identical to SEQ ID NO: 61251
  derived and/or modified sequence opt1 from hemagglutinin__InfluenzaA__ABC43160

SEQ ID NO: 61591 - RNA, 1701 nt, Artificial Sequence; identical to SEQ ID NO: 61251
  derived and/or modified sequence opt1 from hemagglutinin__InfluenzaA__ABC43171

SEQ ID NO: 61592 - RNA, 1701 nt, Artificial Sequence; identical to SEQ ID NO: 61251
  derived and/or modified sequence opt1 from hemagglutinin__InfluenzaA__ABC43182

SEQ ID NO: 61593 - RNA, 1701 nt, Artificial Sequence
  derived and/or modified sequence opt1 from hemagglutinin__InfluenzaA__ABC43475
augaagaccaucaucgcccugagcuacauccucugccugguguucgcccagaagcugcccggcaacgacaacuccaccgcgacgcucugccuggggcaccacgccgucccgaacggcaccaccgugaagaccaucacgaacgaccagaucgaggugaccaacgccaccgagcugguccagagcuccagcaccgggggcaucugcgacagcccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacccuggaguucaacaacgagagcuucaacuggaccggcgugacccagaacgggacguccagcgccugcaagcgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucacggugagcaccaagcgcagccagcagaccgugaucccgaacaucggcucccggccccgcguccgggacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgugaaccgcaucaccuacggcgccugcccccgguacgucaagcagaacacccugaagcucgcgacggggaugcgcaacgugcccgagaagcagacccggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61594 - RNA, 1701 nt, Artificial Sequence; identical to SEQ ID NO: 61251
  derived and/or modified sequence opt1 from hemagglutinin__InfluenzaA__ABC43486

SEQ ID NO: 61595 - RNA, 1701 nt, Artificial Sequence; identical to SEQ ID NO: 61251
  derived and/or modified sequence opt1 from hemagglutinin__InfluenzaA__ABC43497

SEQ ID NO: 61596 - RNA, 1701 nt, Artificial Sequence; identical to SEQ ID NO: 61290
  derived and/or modified sequence opt1 from hemagglutinin__InfluenzaA__ABC43508

SEQ ID NO: 61597 - RNA, 1701 nt, Artificial Sequence; identical to SEQ ID NO: 61290
  derived and/or modified sequence opt1 from hemagglutinin__InfluenzaA__ABC43519

SEQ ID NO: 61598 - RNA, 1701 nt, Artificial Sequence; identical to SEQ ID NO: 61290
  derived and/or modified sequence opt1 from hemagglutinin__InfluenzaA__ABC43530

SEQ ID NO: 61599 - RNA, 1701 nt, Artificial Sequence
  derived and/or modified sequence opt1 from hemagglutinin__InfluenzaA__ABC43552
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccccgggccggaucaccguguccacgaagcgcagccagcagaccgugauccccaacaucggcagccggccccgcguccgggacauccccucccgcaucagcaucuacuggaccaucgugaagccgggggacauccugcucaucaacuccaccggcaaccugaucgcgccccggggguacuucaagauccgcagcggcaaguccagcaucaugcgguccgacgcccccaucggcaagugcaacagcgagugcaucacgcccaacggguccaucccgaacgacaagcccuuccagaacgugaaccgcaucaccuacggcgccugcccccgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 61600 - RNA, 1701 nt, Artificial Sequence
  derived and/or modified sequence opt1 from hemagglutinin__InfluenzaA__ABC46554
augaagaccaucaucgcccugagcuacaucuucugccagguguucgcccagaaccuccccggcaacgacaacuccaccgcgacgcugugccuggggcaccacgccgucccgaacggcacccucgugaagaccaucaccaacgaccagaucgaggugacgaacgccaccgagcugguccagagcuccagcaccgggcgcaucugcgacagcccccaccggauccuggacggcaagaacugcacccucaucgacgcccugcugggggacccccacugcgacggcuuccagaacgagaagugggaccucuucguggagcgcuccaaggccuucuccaacugcuaccccuacgacgugccggacuacgcgagccugcggucccuggucgccagcuccggcacgcucgaguucaucaacgagggguucaacuggaccggcgugacccaggacgggggcagcuacgccugcaagcgcgggcccgacaacuccuucuucagccggcugaacuggcuguacaaguccgagagcaccuaccccgugcucaacgucacgaugcccaacaacgacaacuucgacaagcuguacaucuggggcgugcaccacccguccaccgacaaggagcagaccaaccuguacgugcaggccagcggccgcgucaccguguccacgaagcggagccagcagaccaucauccccaacguggggagccgccccuggguccggggccucuccagccgcaucuccaucuacuggaccaucgugaagcccggggacauccugcugaucaacagcaacggcaaccucaucgcgccgcggggcuacuucaagauccgcaccgggaaguccagcaucaugcgguccgacgcccccaucggcacgugcagcuccgagugcaucacccccaacgggagcauccccaacgacaagccguuccagaacgugaacaagaucaccuacggcgccugccccaaguacgucaagcagaacacccugaagcuggccacggggaugcgcaacgugcccgagaagcagacccggggcaucuucggcgccaucgcgggguucaucgagaacggcugggaggggaugaucgacggcugguacggguuccgccaccagaacuccgagggcaccggccaggccgccgaccucaagagcacccaggccgccaucgaccagaucaacgggaagcugaaccgggugaucgagaagacgaacgagaaguuccaccagaucgagaaggaguucuccgaggucgagggccgcauccaggaccuggagaaguacguggaggacaccaagaucgaccucuggagcuacaacgcggagcugcugguggcccucgagaaccagcacaccaucgaccugaccgacuccgagaugaacaagcuguucgagaagacgcggcgccagcuccgggagaacgccgaggacauggggaacggcugcuucaagaucuaccacaagugcgacaacgccugcaucgggagcauccgcaacggcaccuacgaccacgacgucuaccgcgacgaggcccugaacaaccgguuccagaucaagggcguggagcugaaguccggguacaaggacuggauccucuggaucagcuucgcgaucuccugcuuccugcugugcgucgugcuccugggcuucaucaugugggccugccagaaggggaacauccgcugcaacaucugcaucuga

SEQ ID NO: 61601 - RNA, 1701 nt, Artificial Sequence
  derived and/or modified sequence opt1 from hemagglutinin__InfluenzaA__ABC46576
augaagaccaucaucgcccugagcuacaucuucugccucguguucgcccagaaccugcccggcaacgacaaguccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugguggacgcccugcucggggacccccacugcgacggcuuccagaacgagaagugggaccuguucguggagcgcuccaaggccuucuccaacugcuaccccuacgacgucccggacuacgcgagccugcggucccucguggccagcuccggcacgcuggaguucaucaacgagagcuucaacuggaccggggugacccaguccggcgggagcuacgccugcaagcgcggcuccgacaacagcuucuucucccggcugaacuggcucuacgagagcgaguccaaguaccccguccugaacgugaccaugcccaacaacgggaacuucgacaagcuguacaucuggggcgugcaccaccccagcacggacaaggagcagaccaaccucuacguccgcgccagcggccgggugaccguguccaccaagcgcagccagcagacgaucaucccgaacaucgggucccggcccuggguccgcggccugagcucccggaucagcaucuacuggaccaucgugaagcccggggacauccugcucaucaacuccaacggcaaccugaucgcgccccgcggcuacuucaagauccggaccggcaagagcuccaucaugcgcagcgacgccccgaucgggaccugcuccagcgagugcaucacgcccaacggguccauccccaacgacaagcccuuccagaacgugaacaagaucaccuacggcgccugcccgaaguacgucaagcagaacacccugaagcucgccaccgggaugcggaacgugcccgagaagcagacgcgcggcaucuucggcgccaucgcgggguucaucgagaacggcugggaggggaugguggacggcugguacggguuccggcaccagaacagcgagggcaccggccaggccgccgaccugaaguccacccaggccgccaucgaccagaucaacgggaagcugaaccgcgucaucgagaagaccaacgagaaguuccaccagaucgagaaggaguucagcgagguggagggccggauccaggaccucgagaaguacguggaggacacgaagaucgaccugugguccuacaacgcggagcugcucgucgcccuggagaaccagcacaccaucgaccugaccgacagcgagaugaacaagcuguucgagaagacccgccggcagcuccgcgagaacgccgaggacauggggaacggcugcuucaagaucuaccacaagugcgacaacgccugcaucggguccauccgcaacggcacguacgaccacgacguguaccgggacgaggcccugaacaaccgcuuccagaucaagggcgucgagcucaagagcggguacaaggacuggauccuguggaucagcuucgcgaucuccugcuuccugcucugcguggugcugcugggcuucaucaugugggccugccagaaggggaacauccggugcaacaucugcaucuga

SEQ ID NO: 61602 - RNA, 1701 nt, Artificial Sequence; identical to SEQ ID NO: 61460
  derived and/or modified sequence opt1 from hemagglutinin__InfluenzaA__ABC50167

SEQ ID NO: 61603 - RNA, 1701 nt, Artificial Sequence; identical to SEQ ID NO: 61460
  derived and/or modified sequence opt1 from hemagglutinin__InfluenzaA__ABC50178

SEQ ID NO: 61604 - RNA, 1701 nt, Artificial Sequence; identical to SEQ ID NO: 61460
  derived and/or modified sequence opt1 from hemagglutinin__InfluenzaA__ABC50189

SEQ ID NO: 61605 - RNA, 1701 nt, Artificial Sequence; identical to SEQ ID NO: 61570
  derived and/or modified sequence opt1 from hemagglutinin__InfluenzaA__ABC50200

SEQ ID NO: 61606 - RNA, 1701 nt, Artificial Sequence; identical to SEQ ID NO: 61570
  derived and/or modified sequence opt1 from hemagglutinin__InfluenzaA__ABC50211

SEQ ID NO: 61607 - RNA, 1701 nt, Artificial Sequence; identical to SEQ ID NO: 61570
  derived and/or modified sequence opt1 from hemagglutinin__InfluenzaA__ABC50222

SEQ ID NO: 61608 - RNA, 1701 nt, Artificial Sequence; identical to SEQ ID NO: 61570
  derived and/or modified sequence opt1 from hemagglutinin__InfluenzaA__ABC50233

SEQ ID NO: 61609 - RNA, 1701 nt, Artificial Sequence; identical to SEQ ID NO: 61570
  derived and/or modified sequence opt1 from hemagglutinin__InfluenzaA__ABC50244

SEQ ID NO: 61610 - RNA, 1701 nt, Artificial Sequence; identical to SEQ ID NO: 61570
  derived and/or modified sequence opt1 from hemagglutinin__InfluenzaA__ABC50266

SEQ ID NO: 61611 - RNA, 1701 nt, Artificial Sequence; identical to SEQ ID NO: 61570
  derived and/or modified sequence opt1 from hemagglutinin__InfluenzaA__ABC50277

SEQ ID NO: 61612 - RNA, 1701 nt, Artificial Sequence
  derived and/or modified sequence opt1 from hemagglutinin__InfluenzaA__ABC50299
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucagcuucgccaccagcugcuuccugcugugcaucguccuccugggcuucaucaugugggccugccagaaggggaacauccggugcaacaucugcaucuga

SEQ ID NO: 61613 - RNA, 1701 nt, Artificial Sequence; identical to SEQ ID NO: 61570
  derived and/or modified sequence opt1 from hemagglutinin__InfluenzaA__ABC50310

SEQ ID NO: 61614 - RNA, 1701 nt, Artificial Sequence
  derived and/or modified sequence opt1 from hemagglutinin__InfluenzaA__ABC50321
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccggcaagcagacccgggggaucuucggcgccaucgccggcuucaucgagaacgggugggagggcaugauggacgggugguacggcuuccgccaccagaacuccgaggggaccggccaggccgccgaccugaaguccacgcaggcggccaucaaccagaucaacggcaagcucaaccggcugaucgagaagaccaacgagaaguuccaccagaucgagaaggaguucuccgagguggaggggcgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggcuacaaggacugggugcucuggaucagcuucgccaucagcugcuuccugcugugcaucguccuccugggguucaucaugugggccugccagaagggcaacauccggugcaacaucugcaucuga

SEQ ID NO: 61615 - RNA, 1701 nt, Artificial Sequence
  derived and/or modified sequence opt1 from hemagglutinin__InfluenzaA__ABC50332
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacggcaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggcuucaucgagaacgggugggagggcaugauggacgggugguacggcuuccgccaccagaacuccgaggggaccggccaggccgccgaccugaaguccacgcaggcggccaucaaccagaucaacggcaagcucaaccggcugaucgagaagaccaacgagaaguuccaccagaucgagaaggaguucuccgagguggaggggcgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggcuacaaggacuggauccucuggaucagcuucgccaucagcugcuuccugcugugcaucgugcuccugggguucaucaugugggccugccagaagggcaacauccggugcaacaucugcaucuga

SEQ ID NO: 61616 - RNA, 1701 nt, Artificial Sequence; identical to SEQ ID NO: 61570
  derived and/or modified sequence opt1 from hemagglutinin__InfluenzaA__ABC50343

SEQ ID NO: 61617 - RNA, 1701 nt, Artificial Sequence
  derived and/or modified sequence opt1 from hemagglutinin__InfluenzaA__ABC50354
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcuccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcccaggcgagcgggcgcgugaccgucuccaccaagcggagccagcagaccgugaucccgaacaucggcucccgccccugggugcggggcgucagcucccgcaucagcaucuacuggacgaucgugaagcccggggacauccuccugaucaacuccaccggcaaccugaucgcgccccggggguacuucaagauccgcagcggcaaguccagcaucaugcgguccgacgccccgaucggcaagugcaacagcgagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacagcgagggcaccgggcaggccgccgaccugaaguccacgcaggccgcgaucaaccagaucaacggcaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgccugcaucggguccauccgcaacggcaccuacgaccacgacguguaccgggacgaggcgcugaacaaccgcuuccagaucaagggggucgagcugaaguccggcuacaaggacugggugcucuggaucagcuucgccaucuccugcuuccugcugugcaucguccuccugggcuucaucaugugggccugccagaaggggaacauccggugcaacaucugcaucuga

SEQ ID NO: 61618 - RNA, 1701 nt, Artificial Sequence
  derived and/or modified sequence opt1 from hemagglutinin__InfluenzaA__ABC50376
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacacgggcagccgccccugggugcggggcgucuccagccgcaucuccaucuacuggaccaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugauggacggcugguacggguuccgccaccagaacuccgagggcacggggcaggccgccgaccugaaguccacccaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacacgaucgaccugaccgacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucagcuucgccaucagcugcuuccugcugugcaucguccuccugggcuucaucaugugggccugccagaaggggaacauccggugcaacaucugcaucuga

SEQ ID NO: 61619 - RNA, 1701 nt, Artificial Sequence
  derived and/or modified sequence opt1 from hemagglutinin__InfluenzaA__ABC50387
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacguguggggcgugcaccaccccgggacggacagcgaccagaucucccuguacgcgcaggccagcgggcgcgucaccgugagcaccaagcggucccagcagaccgugaucccgaacaucggcagccgccccuggguccggggcguguccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaaccgcaucaccuacggcgccugcccgcgguacgugaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcugaaguccggcuacaaggacuggguccucuggaucagcuucgccaucagcugcuuccugcugugcaucgugcuccugggcuucaucaugugggccugccagaaggggaacauccggugcaacaucugcaucuga

SEQ ID NO: 61620 - RNA, 1701 nt, Artificial Sequence
  derived and/or modified sequence opt1 from hemagglutinin__InfluenzaA__ABC50409
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgucagccugcggucccucguggcgagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucagccuguacgcccaggcguccggccggaucaccgugagcacgaagcgcagccagcagaccgucaucccgaacaucggcucccggccccgcgugcgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgccaccgggaugcgcaacgugcccgagaagcagacgcggggcaucuucggggcgaucgccggcuucaucgagaacggcugggaggggauggucgacggcugguacggguuccgccaccagaacuccgagggcaucgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 61621 - RNA, 1701 nt, Artificial Sequence; identical to SEQ ID NO: 61620
  derived and/or modified sequence opt1 from hemagglutinin__InfluenzaA__ABC50420

SEQ ID NO: 61622 - RNA, 1701 nt, Artificial Sequence
  derived and/or modified sequence opt1 from hemagglutinin__InfluenzaA__ABC54668
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcgguccaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucggguccggccccugggugcgcggcgugagcucccggaucagcaucuacuggacgaucgucaagcccggggacauccuccugaucaacuccaccggcaaccugaucgcgccccgcggguacuucaagauccggagcggcaaguccagcaucaugcgcuccgacgccccgaucggcaagugcaacagcgagugcaucacccccaacgggucccuccccaacgacaagcccuuccagaacgugaaccggaucaccuacggcgccugcccgcgcuacgugaagcagaacacgcugaagcuggccaccgggaugcggaacguccccgagaagcagacccgcggcaucuucggggccaucgccggcuucaucgagaacggcugggaggggaugguggacggcugguacggguuccggcaccagaacagcgagggcaccgggcaggccgcggaccucaaguccacgcaggccgccaucaaccagaucaacggcaagcugaaccgccugaucgagaagaccaacgagaaguuccaccagaucgagaaggaguucagcgagguggagggccggauccaggaccucgagaaguacgucgaggacaccaagaucgaccugugguccuacaacgccgagcugcucguggcccuggagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcucaagagcggcuacaaggacuggauccuguggaucagcuucgccaucuccugcuuccugcucugcgugguccugcugggcuucaucaugugggccugccagaaggggaacauccgcugcaacaucugcaucuga

SEQ ID NO: 61623 - RNA, 1701 nt, Artificial Sequence
  derived and/or modified sequence opt1 from hemagglutinin__InfluenzaA__ABC54679
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcucccccaccgggggcaucugcgacagcccccaccagauccucgacggggagaacugcacccugaucgacgcccugcucggcgacccccagugcgacggcuuccagaacaagaagugggaccuguucaucgagcgcuccaaggccuacagcaacugcuacccguacgacgugcccgacuacgcgucccugcggagccucguggccuccagcgggacgcuggaguucaacaacgaguccuucaacuggaccggcgucacccagaacgggaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcgugcaccacccggggaccgacaacgaccagaucucccuguacgcgcaggccagcggccggaucaccgucuccacgaagcgcagccagcagaccgugauccccaacgugggcagccggccccgcguccgggacauccccucccgcaucagcaucuacuggaccaucgugaagccgggggacauccugcucaucaacuccaccggcaaccugaucgcgccccggggguacuucaagauccgcagcggcaaguccagcaucaugcgguccgacgcccccaucggcaagugcaacagcgagugcaucacgcccaacggguccaucccgaacgacaagcccuuccagaacgugaaccgcaucaccuacggcgccugcccccgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 61624 - RNA, 1701 nt, Artificial Sequence; identical to SEQ ID NO: 61524
  derived and/or modified sequence opt1 from hemagglutinin__InfluenzaA__ABC67319

SEQ ID NO: 61625 - RNA, 1701 nt, Artificial Sequence
  derived and/or modified sequence opt1 from hemagglutinin__InfluenzaA__ABC67454
augaagaccaucaucgcccugagcuacauccucugccugguguucgcccaggagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucagcuucgccaucagcugcuuccugcugugcaucguccuccugggcuucaucaugugggccugccagaaggggaacauccggugcaacaucugcaucuga

SEQ ID NO: 61626 - RNA, 1701 nt, Artificial Sequence; identical to SEQ ID NO: 61570
  derived and/or modified sequence opt1 from hemagglutinin__InfluenzaA__ABC67471

SEQ ID NO: 61627 - RNA, 1701 nt, Artificial Sequence
  derived and/or modified sequence opt1 from hemagglutinin__InfluenzaA__ABC67554
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccgacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucgugaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 61628 - RNA, 1701 nt, Artificial Sequence
  derived and/or modified sequence opt1 from hemagglutinin__InfluenzaA__ABC67565
augaagaccaucaucgcccugagcuacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccagcaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccagcgggacccuggaguucaucaacgagggcuucaccuggaccggggugacgcagaacggcggguccaacgccugcaagcggggccccgacaucggcuucuucagccgccugaacuggcucuacaaguccgggagcaccuaccccgugcugaacgucaccaugcccaacaacgacaacuucgacaagcuguacaucuggggcgugcaccacccguccaccgaccaggagcagacgagccucuacgugcaggccuccgggcgggucaccgugagcaccaagcgcucccagcagaccaucauccccaacaucggcagccggcccugggugcgcggccugagcucccggaucagcaucuacuggacgaucgucaagcccggggacauccuggugaucaacuccaacggcaaccucaucgccccgcgcggguacuucaagaugcggaccggcaagagcuccaucaugcgcagcgacgcgcccaucgggaccugcaucuccgagugcaucacccccaacggcagcauccccaacgacaagccguuccagaacgugaacaagaucacguacggcgccugccccaaguacgucaagcagaacacccugaagcuggccaccgggaugcggaacgugcccgagaagcagacccgcggccucuucggggccaucgccggcuucaucgagaacgggugggagggcaugaucgacggcugguacggguuccggcaccagaacuccgagggcacggggcaggcggccgaccucaagagcacccaggccgccaucgaccagaucaacggcaagcugaaccgcgugaucgagaagaccaacgagaaguuccaccagaucgagaaggaguucuccgaggucgaggggcggauccaggaccucgagaaguacguggaggacaccaagaucgaccuguggagcuacaacgccgagcugcucguggcgcuggagaaccagcacacgaucgaccugaccgacuccgagaugaacaagcuguucgagaagacccgccggcagcugcgcgagaacgccgaggacaugggcaacggcugcuucaagaucuaccacaagugcgacaacgccugcaucgggagcauccggaacggcaccuacgaccacgacgucuaccgcgacgaggcccugaacaaccgcuuccagaucaaggggguggagcucaaguccggcuacaaggacuggauccuguggaucagcuucgccaucuccugcuuccugcucugcgucgugcugcugggcuucaucaugugggcgugccagaaggggaacauccggugcaacaucugcaucuga

SEQ ID NO: 61629 - RNA, 1701 nt, Artificial Sequence
  derived and/or modified sequence opt1 from hemagglutinin__InfluenzaA__ABC67576
augaagaccaucaucgcccugagcuacauccucugccugguguucgcccagaagcugcccggcaacgacaacuccauggcgacccucugccuggggcaccacgccgucccgaacggcacgcuggugaagaccaucaccaacgaccagaucgaggugaccaacgccacggagcucguccagagcuccagcaccgggcgcaucugcgacagcccccaccggauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacccuggaguucaacaacgagagcuucaacuggacggggguggcccagaacggcaccuccuacgccugcaagcgccggagcaucaaguccuucuucagccgccucaacuggcugcaccagcugaaguacaaguaccccgcgcucaacgugaccaugcccaacaacgacgaguucgacaagcuguacaucuggggcguccaccaccccuccaccgacagcgaccagacgucccuguacgcccaggccagcgggcgggugaccgugagcaccaagcgcucccagcagaccgucaucccgaacaucgggagccggcccugggugcgcggcguguccagccggaucuccaucuacuggacgaucgucaagcccggcgacauccuccugaucaacagcaccgggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacuccgaggggaccggccaggccgcggaccucaagagcacgcaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcacccgcaagcagcuccgggagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 61630 - RNA, 1701 nt, Artificial Sequence
  derived and/or modified sequence opt1 from hemagglutinin__InfluenzaA__ABC67587
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggccccugcccccgguacgucaagcagaacacccugaagcucgccaccgggaugcgcaacgugcccgagaagcagacgcggggcaucuucggggcgaucgccggcuucaucgagaacggcugggaggggaugguggacggcugguacggguuccgccaccagaacuccgagggcaucgggcaggccgccgaccugaaguccacccaggccgcgaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggaccuacgaccacgacgucuaccgggacgaggcgcucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61631 - RNA, 1701 nt, Artificial Sequence; identical to SEQ ID NO: 61251
  derived and/or modified sequence opt1 from hemagglutinin__InfluenzaA__ABC67598

SEQ ID NO: 61632 - RNA, 1701 nt, Artificial Sequence; identical to SEQ ID NO: 61570
  derived and/or modified sequence opt1 from hemagglutinin__InfluenzaA__ABC67609

SEQ ID NO: 61633 - RNA, 1701 nt, Artificial Sequence; identical to SEQ ID NO: 61570
  derived and/or modified sequence opt1 from hemagglutinin__InfluenzaA__ABC67620

SEQ ID NO: 61634 - RNA, 1701 nt, Artificial Sequence; identical to SEQ ID NO: 61570
  derived and/or modified sequence opt1 from hemagglutinin__InfluenzaA__ABC67631

SEQ ID NO: 61635 - RNA, 1701 nt, Artificial Sequence; identical to SEQ ID NO: 61570
  derived and/or modified sequence opt1 from hemagglutinin__InfluenzaA__ABC67642

SEQ ID NO: 61636 - RNA, 1701 nt, Artificial Sequence
  derived and/or modified sequence opt1 from hemagglutinin__InfluenzaA__ABC67653
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucagcuucgccaucagcugcuuccugcugugcgucgugcuccugggcuucaucaugugggccugccagaaggggaacauccggugcaacaucugcaucuga

SEQ ID NO: 61637 - RNA, 1701 nt, Artificial Sequence
  derived and/or modified sequence opt1 from hemagglutinin__InfluenzaA__ABC67697
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaaggagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 61638 - RNA, 1701 nt, Artificial Sequence
  derived and/or modified sequence opt1 from hemagglutinin__InfluenzaA__ABC67708
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 61639 - RNA, 1701 nt, Artificial Sequence; identical to SEQ ID NO: 61638
  derived and/or modified sequence opt1 from hemagglutinin__InfluenzaA__ABC67719

SEQ ID NO: 61640 - RNA, 1701 nt, Artificial Sequence; identical to SEQ ID NO: 61638
  derived and/or modified sequence opt1 from hemagglutinin__InfluenzaA__ABC67733

SEQ ID NO: 61641 - RNA, 1701 nt, Artificial Sequence
  derived and/or modified sequence opt1 from hemagglutinin__InfluenzaA__ABC67806
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 61642 - RNA, 1701 nt, Artificial Sequence; identical to SEQ ID NO: 61524
  derived and/or modified sequence opt1 from hemagglutinin__InfluenzaA__ABC67817

SEQ ID NO: 61643 - RNA, 1701 nt, Artificial Sequence; identical to SEQ ID NO: 61638
  derived and/or modified sequence opt1 from hemagglutinin__InfluenzaA__ABC67828

SEQ ID NO: 61644 - RNA, 1701 nt, Artificial Sequence; identical to SEQ ID NO: 61502
  derived and/or modified sequence opt1 from hemagglutinin__InfluenzaA__ABC67839

SEQ ID NO: 61645 - RNA, 1701 nt, Artificial Sequence
  derived and/or modified sequence opt1 from hemagglutinin__InfluenzaA__ABC67850
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggcccggggcguguccagccgcaucuccauccacuggacgaucgucaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgugaagcagaacacgcucaagcuggccaccgggaugcgcaacguccccgagaagcagacccggggcaucuucggggccaucgccggcuucaucgagaacggcugggaggggaugauggacggcugguacggguuccgccaccagaacuccgagggcaccgggcaggccgcggaccugaaguccacgcaggccgccaucaaccagaucaacggcaagcucaaccggcugaucgagaagaccaacgagaaguuccaccagaucgagaaggaguucuccgagguggagggccgcauccaggaccuggagaaguacguggaggacaccaagaucgaccucuggagcuacaacgccgagcugcuggucgcccucgagaaccagcacaccaucgaccugacggacuccgagaugaacaagcuguucgagcggaccaagaagcagcuccgcgagaacgcggaggacauggggaacggcugcuucaagaucuaccacaagugcgacaacgccugcaucgggagcauccgcaacggcaccuacgaccacgacguguaccgggacgaggcccugaacaaccgcuuccagaucaaggggguggagcugaaguccggcuacaaggacuggguccucuggaucagcuucgccaucagcugcuuccugcugugcaucgugcuccugggcuucaucaugugggccugccagaaggggaacauccggugcaacaucugcaucuga

SEQ ID NO: 61646 - RNA, 1701 nt, Artificial Sequence; identical to SEQ ID NO: 61502
  derived and/or modified sequence opt1 from hemagglutinin__InfluenzaA__ABC67861

SEQ ID NO: 61647 - RNA, 1701 nt, Artificial Sequence; identical to SEQ ID NO: 61570
  derived and/or modified sequence opt1 from hemagglutinin__InfluenzaA__ABC67883

SEQ ID NO: 61648 - RNA, 1701 nt, Artificial Sequence
  derived and/or modified sequence opt1 from hemagglutinin__InfluenzaA__ABC67894
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucuccaagcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgggugaccgucagcaccaagcgcucccagcagaccgugaucccgaacaucggcagccggcccugggugcgcggcgucuccagccggaucuccaucuacuggacgaucgugaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggcggccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacugggugcucuggaucagcuucgccaucagcugcuuccugcugugcaucguccuccugggcuucaucaugugggccugccagaaggggaacauccgcugcaacaucugcaucuga

SEQ ID NO: 61649 - RNA, 1701 nt, Artificial Sequence; identical to SEQ ID NO: 61570
  derived and/or modified sequence opt1 from hemagglutinin__InfluenzaA__ABC67967

SEQ ID NO: 61650 - RNA, 1701 nt, Artificial Sequence; identical to SEQ ID NO: 61570
  derived and/or modified sequence opt1 from hemagglutinin__InfluenzaA__ABC67978

SEQ ID NO: 61651 - RNA, 1701 nt, Artificial Sequence
  derived and/or modified sequence opt1 from hemagglutinin__InfluenzaA__ABC67989
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaaggucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgugugcaucgggagcauccgcaacggcaccuacgaccacgacgucuaccgggacgaggcgcugaacaaccgcuuccagaucaaggggguggagcugaaguccggcuacaaggacuggguccucuggaucagcuucgccaucagcugcuuccugcugugcaucgugcuccugggcuucaucaugugggccugccagaaggggaacauccggugcaacaucugcaucuga

SEQ ID NO: 61652 - RNA, 1701 nt, Artificial Sequence; identical to SEQ ID NO: 61625
  derived and/or modified sequence opt1 from hemagglutinin__InfluenzaA__ABC68000

SEQ ID NO: 61653 - RNA, 1701 nt, Artificial Sequence
  derived and/or modified sequence opt1 from hemagglutinin__InfluenzaA__ABC68049
augaagaccaucaucgcccugagcuacauccucugccugguguucgcccagaagcugcccggcaacgacaacuccaccgcgacgcucugccuggggcaccacgccgucccgaacggcacccuggugaagaccaucaccgacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacguguggggcgugcaccaccccgggacggacagcgaccagaucucccuguacgcgcaggccagcgggcgcgucaccgugagcaccaagcggucccagcagaccgugaucccgaacaucggcagccgccccuggguccggggcguguccagcaagaucuccaucuacuggacgaucgugaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgucaaccggaucaccuacggcgccugcccgcgcuacgugaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggcggccaucaaccagaucaacggcaagcucaaccgccugaucgagaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcugaaguccggcuacaaggacuggguccucuggaucagcuucgccaucagcugcuuccugcugugcaucgugcuccugggcuucaucaugugggccugccagaaggggaacauccgcugcaacaucugcaucuga

SEQ ID NO: 61654 - RNA, 1701 nt, Artificial Sequence; identical to SEQ ID NO: 61570
  derived and/or modified sequence opt1 from hemagglutinin__InfluenzaA__ABC68060

SEQ ID NO: 61655 - RNA, 1701 nt, Artificial Sequence
  derived and/or modified sequence opt1 from hemagglutinin__InfluenzaA__ABC68071
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacaacguguaccgggacgaggcccugaacaaccgcuuccagaucaagggggucgagcugaaguccggcuacaaggacugggugcucuggaucagcuucgccaucagcugcuuccugcugugcaucguccuccugggcuucaucaugugggccugccagaaggggaacauccggugcaacaucugcaucuga

SEQ ID NO: 61656 - RNA, 1701 nt, Artificial Sequence; identical to SEQ ID NO: 61638
  derived and/or modified sequence opt1 from hemagglutinin__InfluenzaA__ABC68082

SEQ ID NO: 61657 - RNA, 1701 nt, Artificial Sequence
  derived and/or modified sequence opt1 from hemagglutinin__InfluenzaA__ABC68093
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccagcggccgcgugaccgucuccaccaagcggagccagcagaccgugaucccgaacaucgggucccgccccugggugcggggcgucagcuccaucaucagcaucuacuggacgaucgugaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgggaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacagcgagggcaccgggcaggccgccgaccugaaguccacgcaggcggccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaagggggucgagcucaagagcggcuacaaggacuggauccuguggaucagcuucgccaccuccugcuuccugcugugcaucgugcuccugggcuucaucaugugggccugccagaaggggaacauccgcugcaacaucugcaucuga

SEQ ID NO: 61658 - RNA, 1701 nt, Artificial Sequence
  derived and/or modified sequence opt1 from hemagglutinin__InfluenzaA__ABC68222
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccuccugaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 61659 - RNA, 1701 nt, Artificial Sequence; identical to SEQ ID NO: 61450
  derived and/or modified sequence opt1 from hemagglutinin__InfluenzaA__ABC68233

SEQ ID NO: 61660 - RNA, 1707 nt, Artificial Sequence
  derived and/or modified sequence opt1 from hemagglutinin__InfluenzaA__ABC72655
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaagcccaaccccgccaacgaccucugcuacccgggggacuucaacgacuacgaggagcugaagcaccuccucucccggaucaaccacuucgagaagauccagaucauccccaagagcuccuggagcucccacgaggccagcgucggcguguccagcgugugccccuaccagggcaaguccagcuucuuccgcaacgucguguggcugaucaagaagaacuccaccuaccccacgaucaagcggagcuacaacaacaccaaccaggaggaccugcucgugcugugggggauccaccacccgaacgacgccgcggagcagaccaagcuguaccagaaccccaccacguacaucuccgucggcaccagcacccucaaccagcgccuggugccccggaucgccacccgcuccaaggugaacgggcagagcggccggauggaguucuucuggacgauccugaagcccaacgacgccaucaacuucgagagcaacgggaacuucaucgccccggaguacgcguacaagaucgucaagaagggcgacuccaccaucaugaaguccgagcucgaguacggcaacugcaacaccaagugccagacccccaugggggccaucaacagcagcaugcccuuccacaacauccacccccugacgaucggcgagugcccgaaguacgugaaguccaaccgccuggugcucgccaccgggcugcggaacagcccccagcgcgagaagcggcgcaagaagcggggccuguucggcgccaucgccggguucaucgagggcggguggcagggcauggucgacgggugguacggcuaccaccacuccaacgagcagggcagcggguacgcggccgacaaggaguccacccagaaggccaucgacggcgugaccaacaaggugaacagcaucaucgacaagaugaacacgcaguucgaggccgucgggcgcgaguucaacaaccucgagcggcgcaucgagaaccugaacaagaagauggaggacggcuuccuggacguguggaccuacaacgccgagcuccugguccugauggagaacgagcggacccucgacuuccacgacuccaacgugaagaaccuguacgacaaggugcgccugcagcuccgggacaacgcgaaggagcuggggaacggcugcuucgaguucuaccacaagugcgacaacgagugcauggagagcguccgcaacggcaccuacgacuacccccaguacuccgaggaggcccggcugaagcgcgaggagaucagcggggugaagcucgaguccaucggcaucuaccagauccugagcaucuacuccacgguggccagcucccuggcccucgccaucauggucgcggggcugagccuguggaugugcagcaacggcucccuccagugccgcaucugcaucuga

SEQ ID NO: 61661 - RNA, 1701 nt, Artificial Sequence; identical to SEQ ID NO: 61251
  derived and/or modified sequence opt1 from hemagglutinin__InfluenzaA__ABC84400

SEQ ID NO: 61662 - RNA, 1701 nt, Artificial Sequence; identical to SEQ ID NO: 61460
  derived and/or modified sequence opt1 from hemagglutinin__InfluenzaA__ABC84411

SEQ ID NO: 61663 - RNA, 1701 nt, Artificial Sequence
  derived and/or modified sequence opt1 from hemagglutinin__InfluenzaA__ABC84433
augaagaccaucaucgcccugagcuacauccucugccugguguucgcccagaagcugcccggcaacgacaaccgcaccgcgacgcucugccuggggcaccacgccgucccgaacggcaccaucgugaagaccaucaccaacgaccagaucgaggugacgaacgccaccgagcugguccaguccagcuccaccgggggcaucugcgacagcccccaccagauccucgacggggagaacugcacccugaucgacgcccugcucggcgacccccagugcgacggcuuccagaacaagaagugggaccuguucguggagcgguccaaggccuacagcaacugcuaccccuacgacgugccggacuacgcgucccugcgcagccucgucgccuccagcgggacgcuggaguucaacaacgaguccuucaacuggaccggcgugacccagaacgggaccagcuccgccugcaagcggcgcagcaacaacuccuucuucagccggcugaacuggcucacgcaccugaaguucaaguaccccgcccugaacgugaccaugcccaacaacgagaaguucgacaagcucuacaucuggggcguccaccaccccgggaccaacaacgaccagaucucccuguacgcgcaggccagcggccgcaucaccguguccacgaagcggagccagcagaccgugaucccgaacaucggcagccgcccccggguccgcgacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacagcgagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcucaagagcggcuacaaggacuggauccuguggaucuccuucgccaucagcugcuuccugcugugcguggcccugcucggguucaucaugugggccugccagaagggcaacauccgcugcaacaucugcaucuga

SEQ ID NO: 61664 - RNA, 1701 nt, Artificial Sequence; identical to SEQ ID NO: 61570
  derived and/or modified sequence opt1 from hemagglutinin__InfluenzaA__ABC84444

SEQ ID NO: 61665 - RNA, 1701 nt, Artificial Sequence; identical to SEQ ID NO: 61641
  derived and/or modified sequence opt1 from hemagglutinin__InfluenzaA__ABC84498

SEQ ID NO: 61666 - RNA, 1701 nt, Artificial Sequence; identical to SEQ ID NO: 61641
  derived and/or modified sequence opt1 from hemagglutinin__InfluenzaA__ABC84509

SEQ ID NO: 61667 - RNA, 1701 nt, Artificial Sequence
  derived and/or modified sequence opt1 from hemagglutinin__InfluenzaA__ABC84520
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccgggacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 61668 - RNA, 1701 nt, Artificial Sequence
  derived and/or modified sequence opt1 from hemagglutinin__InfluenzaA__ABC84531
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgagggguucaacuggaccggcgugacccagagcgggggcuccuacgccugcaagcgcgggagcgugaacuccuucuucagccggcugaacuggcucuacgaguccgagagcaaguaccccgcccugaacgucaccaugcccaacaacggccgcuucgacaagcuguacaucuggggcgugcaccaccccuccacggacaaggagcagaccaaccucuacgugcgggcggccgggcgcgucaccgugagcaccaagcggagccagcagacggugaucccgaacaucggcucccgccccuggguccgggggcugagcucccgcaucagcaucuacuggaccaucgugaagcccggcgacauccugcucaucaacuccaccggcaaccugaucgcgccccggggguacuucaagauccgcaccggcaagagcuccaucaugcggagcgacgccccgaucgggacgugcuccagcgagugcaucacccccaacggcuccauccccaacgacaagcccuuccagaacgugaacaagaucaccuacggggccugcccgcgcuacgucaagcagaacacccugaagcucgccacgggcaugcggaacgugcccgagaagcagacccgcggcaucuucggggccaucgccggcuucaucgagaacgggugggagggcaugguggacgggugguacggcuuccggcaccagaacagcgagggcaccgggcaggccgccgaccugaaguccacccaggcggccaucgaccagaucaacggcaagcugaaccgccucaucgagaagacgaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacaccaucgaccucaccgacagcgagaugaacaagcuguucgagaagacgcgcaagcagcugcgcgagaacgccgaggacaugggcaacgggugcuucaagaucuaccacaagugcgacaacgcgugcaucggcuccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcgucgugcugcucggguucaucaugugggccugccagaagggcaacauccgcugcaacaucugcaucuga

SEQ ID NO: 61669 - RNA, 1701 nt, Artificial Sequence; identical to SEQ ID NO: 61658
  derived and/or modified sequence opt1 from hemagglutinin__InfluenzaA__ABC84560

SEQ ID NO: 61670 - RNA, 1701 nt, Artificial Sequence
  derived and/or modified sequence opt1 from hemagglutinin__InfluenzaA__ABC84571
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagaucaucgacggggagaacugcacccugaucgacgcccugcucggcgacccccacugcgacggcuuccagaacaaggagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcguggcccagaacgggaccuccagcgccugcaagcgccgguccaacaagagcuucuucucccgccugaacuggcuccaccagcugaaguacaaguaccccgcgcugaacgugaccaugcccaacaacgagaaguucgacaagcucuacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccugcucaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcugaagcucgccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcugaaccgccucaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagcgcaccaagaagcagcugcgggagaacgcggaggacauggggaacggcugcuucaagaucuaccacaagugcgacaacgccugcaucgggagcauccgcaacggcaccuacgaccacgacguguaccgcgacgaggcccucaacaaccgguuccagaucaagggggucgagcugaaguccggcuacaaggacuggauccuguggaucagcuucgccaucagcugcuuccuccugugcgugguccugcucggcuucaucaugugggccugccagaaggggaacauccgcugcaacaucugcaucuga

SEQ ID NO: 61671 - RNA, 1701 nt, Artificial Sequence; identical to SEQ ID NO: 61658
  derived and/or modified sequence opt1 from hemagglutinin__InfluenzaA__ABC85754

SEQ ID NO: 61672 - RNA, 1701 nt, Artificial Sequence; identical to SEQ ID NO: 61638
  derived and/or modified sequence opt1 from hemagglutinin__InfluenzaA__ABC85765

SEQ ID NO: 61673 - RNA, 1701 nt, Artificial Sequence
  derived and/or modified sequence opt1 from hemagglutinin__InfluenzaA__ABC85776
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccuccugaucaacuucaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 61674 - RNA, 1701 nt, Artificial Sequence; identical to SEQ ID NO: 61658
  derived and/or modified sequence opt1 from hemagglutinin__InfluenzaA__ABC85787

SEQ ID NO: 61675 - RNA, 1701 nt, Artificial Sequence; identical to SEQ ID NO: 61641
  derived and/or modified sequence opt1 from hemagglutinin__InfluenzaA__ABC85798

SEQ ID NO: 61676 - RNA, 1701 nt, Artificial Sequence; identical to SEQ ID NO: 61638
  derived and/or modified sequence opt1 from hemagglutinin__InfluenzaA__ABC85820

SEQ ID NO: 61677 - RNA, 1701 nt, Artificial Sequence; identical to SEQ ID NO: 61638
  derived and/or modified sequence opt1 from hemagglutinin__InfluenzaA__ABC85831

SEQ ID NO: 61678 - RNA, 1701 nt, Artificial Sequence; identical to SEQ ID NO: 61641
  derived and/or modified sequence opt1 from hemagglutinin__InfluenzaA__ABC85842

SEQ ID NO: 61679 - RNA, 1701 nt, Artificial Sequence; identical to SEQ ID NO: 61638
  derived and/or modified sequence opt1 from hemagglutinin__InfluenzaA__ABC85853

SEQ ID NO: 61680 - RNA, 1701 nt, Artificial Sequence; identical to SEQ ID NO: 61638
  derived and/or modified sequence opt1 from hemagglutinin__InfluenzaA__ABC85864

SEQ ID NO: 61681 - RNA, 1701 nt, Artificial Sequence; identical to SEQ ID NO: 61641
  derived and/or modified sequence opt1 from hemagglutinin__InfluenzaA__ABC85886

SEQ ID NO: 61682 - RNA, 1701 nt, Artificial Sequence; identical to SEQ ID NO: 61570
  derived and/or modified sequence opt1 from hemagglutinin__InfluenzaA__ABC85908

SEQ ID NO: 61683 - RNA, 1701 nt, Artificial Sequence
  derived and/or modified sequence opt1 from hemagglutinin__InfluenzaA__ABC85919
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucagcuucgccaucagcugcuuccugcugugcaucguccucaugggcuucaucaugugggccugccagaaggggaacauccggugcaacaucugcaucuga

SEQ ID NO: 61684 - RNA, 1701 nt, Artificial Sequence; identical to SEQ ID NO: 61570
  derived and/or modified sequence opt1 from hemagglutinin__InfluenzaA__ABC85930

SEQ ID NO: 61685 - RNA, 1701 nt, Artificial Sequence; identical to SEQ ID NO: 61619
  derived and/or modified sequence opt1 from hemagglutinin__InfluenzaA__ABC85941

SEQ ID NO: 61686 - RNA, 1701 nt, Artificial Sequence
  derived and/or modified sequence opt1 from hemagglutinin__InfluenzaA__ABC85952
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaagaagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccacaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacugggugcucuggaucagcuucgccaucagcugcuuccugcugugcaucguccuccugggcuucaucaugugggccugccagaaggggaacauccggugcaacaucugcaucuga

SEQ ID NO: 61687 - RNA, 1701 nt, Artificial Sequence; identical to SEQ ID NO: 61570
  derived and/or modified sequence opt1 from hemagglutinin__InfluenzaA__ABC85974

SEQ ID NO: 61688 - RNA, 1701 nt, Artificial Sequence; identical to SEQ ID NO: 61570
  derived and/or modified sequence opt1 from hemagglutinin__InfluenzaA__ABC85985

SEQ ID NO: 61689 - RNA, 1701 nt, Artificial Sequence
  derived and/or modified sequence opt1 from hemagglutinin__InfluenzaA__ABC85996
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugauggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61690 - RNA, 1701 nt, Artificial Sequence; identical to SEQ ID NO: 61251
  derived and/or modified sequence opt1 from hemagglutinin__InfluenzaA__ABC86007

SEQ ID NO: 61691 - RNA, 1701 nt, Artificial Sequence
  derived and/or modified sequence opt1 from hemagglutinin__InfluenzaA__ABC86018
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcaccaucaucgacgcccugcugggcgacccccagugcgacggcuuccagaacaagaagugggaccucuucguggagcgcuccaaggccuacuccaacugcuaccccuacgacgugccggacuacgcgagccugcggucccuggucgccagcuccgggacgcucgaguucaacaacgagagcuucaacuggaccggcgugacccagaacgggaccuccagcgccugcaagcgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccgacaacgaccagaucagccucuacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcugaucaacagcaccggcaaccucaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 61692 - RNA, 1701 nt, Artificial Sequence; identical to SEQ ID NO: 61251
  derived and/or modified sequence opt1 from hemagglutinin__InfluenzaA__ABC86029

SEQ ID NO: 61693 - RNA, 1701 nt, Artificial Sequence; identical to SEQ ID NO: 61290
  derived and/or modified sequence opt1 from hemagglutinin__InfluenzaA__ABC86040

SEQ ID NO: 61694 - RNA, 1701 nt, Artificial Sequence; identical to SEQ ID NO: 61524
  derived and/or modified sequence opt1 from hemagglutinin__InfluenzaA__ABC86124

SEQ ID NO: 61695 - RNA, 1701 nt, Artificial Sequence; identical to SEQ ID NO: 61601
  derived and/or modified sequence opt1 from hemagglutinin__InfluenzaA__ABC86137

SEQ ID NO: 61696 - RNA, 1701 nt, Artificial Sequence
  derived and/or modified sequence opt1 from hemagglutinin__InfluenzaA__ABC97374
augaagaccaucaucgcccugagcuacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccagcaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccagcgggacccuggaguucaucaacgagggcuucaccuggaccggggugacgcagaacggcggguccaacgccugcaagcggggccccgacagcggcuucuucucccgccugaacuggcucuacaagagcggguccaccuaccccgugcugaacgucaccaugcccaacaacgacaacuucgacaagcuguacaucuggggcgugcaccacccgagcaccgaccaggagcagacgucccucuacgugcaggccagcgggcgggucaccguguccaccaagcgcagccagcagaccaucauccccaacaucggcagccggcccugggugcgcggccuguccagccggaucuccaucuacuggacgaucgucaagcccggggacauccuggugaucaacagcaacggcaaccucaucgccccgcgcggguacuucaagaugcggaccggcaaguccagcaucaugcgcuccgacgcgcccaucgggaccugcaucagcgagugcaucacccccaacggcuccauccccaacgacaagccguuccagaacgugaacaagaucacguacggcgccugccccaaguacgucaagcagaacacccugaagcuggccaccgggaugcggaacgugcccgagaagcagacccgcggccucuucggggccaucgccggcuucaucgagaacgggugggagggcaugguggacggcugguacggguuccggcaccagaacagcgagggcacggggcaggcggccgaccugaaguccacccaggccgccaucgaccagaucaacggcaagcugaaccgcgucaucgagaagaccaacgagaaguuccaccagaucgagaaggaguucagcgagguggaggggcggauccaggaccucgagaaguacguggaggacaccaagaucgaccugugguccuacaacgccgagcugcucgucgcgcuggagaaccagcacacgaucgaccugaccgacagcgagaugaacaagcuguucgagaagacccgccggcagcuccgcgagaacgccgaggacaugggcaacggcugcuuccggaucuaccacaagugcgacaacgccugcaucggguccauccgcaacggcaccuacgaccacgacguguaccgcgacgaggcccugaacaaccgguuccagaucaagggggucgagcucaagagcggcuacaaggacuggauccuguggaucuccuucgccaucagcugcuuccugcucugcguggugcugcugggcuucaucaugugggcgugccagaaggggaacauccgcugcaacaucugcaucuga

SEQ ID NO: 61697 - RNA, 1701 nt, Artificial Sequence; identical to SEQ ID NO: 61040
  derived and/or modified sequence opt1 from hemagglutinin__InfluenzaA__ABD15449

SEQ ID NO: 61698 - RNA, 1701 nt, Artificial Sequence
  derived and/or modified sequence opt1 from hemagglutinin__InfluenzaA__ABD15460
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagccccuaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 61699 - RNA, 1701 nt, Artificial Sequence; identical to SEQ ID NO: 61040
  derived and/or modified sequence opt1 from hemagglutinin__InfluenzaA__ABD15471

SEQ ID NO: 61700 - RNA, 1701 nt, Artificial Sequence; identical to SEQ ID NO: 61040
  derived and/or modified sequence opt1 from hemagglutinin__InfluenzaA__ABD15482

SEQ ID NO: 61701 - RNA, 1701 nt, Artificial Sequence; identical to SEQ ID NO: 61698
  derived and/or modified sequence opt1 from hemagglutinin__InfluenzaA__ABD15493

SEQ ID NO: 61702 - RNA, 1701 nt, Artificial Sequence; identical to SEQ ID NO: 61251
  derived and/or modified sequence opt1 from hemagglutinin__InfluenzaA__ABD15526

SEQ ID NO: 61703 - RNA, 1701 nt, Artificial Sequence; identical to SEQ ID NO: 61460
  derived and/or modified sequence opt1 from hemagglutinin__InfluenzaA__ABD15537

SEQ ID NO: 61704 - RNA, 1701 nt, Artificial Sequence; identical to SEQ ID NO: 61460
  derived and/or modified sequence opt1 from hemagglutinin__InfluenzaA__ABD15548

SEQ ID NO: 61705 - RNA, 1701 nt, Artificial Sequence; identical to SEQ ID NO: 61478
  derived and/or modified sequence opt1 from hemagglutinin__InfluenzaA__ABD15559

SEQ ID NO: 61706 - RNA, 1701 nt, Artificial Sequence; identical to SEQ ID NO: 61460
  derived and/or modified sequence opt1 from hemagglutinin__InfluenzaA__ABD15570

SEQ ID NO: 61707 - RNA, 1701 nt, Artificial Sequence; identical to SEQ ID NO: 61478
  derived and/or modified sequence opt1 from hemagglutinin__InfluenzaA__ABD15581

SEQ ID NO: 61708 - RNA, 1701 nt, Artificial Sequence; identical to SEQ ID NO: 61460
  derived and/or modified sequence opt1 from hemagglutinin__InfluenzaA__ABD15592

SEQ ID NO: 61709 - RNA, 1701 nt, Artificial Sequence; identical to SEQ ID NO: 61460
  derived and/or modified sequence opt1 from hemagglutinin__InfluenzaA__ABD15603

SEQ ID NO: 61710 - RNA, 1701 nt, Artificial Sequence; identical to SEQ ID NO: 61460
  derived and/or modified sequence opt1 from hemagglutinin__InfluenzaA__ABD15614

SEQ ID NO: 61711 - RNA, 1701 nt, Artificial Sequence
  derived and/or modified sequence opt1 from hemagglutinin__InfluenzaA__ABD15625
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccagaucuccaucuacuggaccaucgugaagcccggggacauccugcucaucaacagcaccggcaaccugaucgcgccccgcggguacuucaagauccgguccggcaagagcuccaucaugcgcagcgacgccccgaucggcaagugcaacuccgagugcaucacgcccaacgggagcauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggugaaguacgucgaggacacgaagaucgaccuguggagcuacaacgccgagcuccugguggcccuggagaaccagcacaccaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggacguacgaccacgacguguaccgcgacgaggcccucaacaaccgguuccagaucaagggcgucgagcugaaguccggcuacaaggacuggauccuguggaucagcuucgccaucagcugcuuccuccugugcguggcccugcucggguucaucaugugggccugccagaagggcaacauccgcugcaacaucugcaucuga

SEQ ID NO: 61712 - RNA, 1701 nt, Artificial Sequence; identical to SEQ ID NO: 61478
  derived and/or modified sequence opt1 from hemagglutinin__InfluenzaA__ABD15636

SEQ ID NO: 61713 - RNA, 1701 nt, Artificial Sequence; identical to SEQ ID NO: 61658
  derived and/or modified sequence opt1 from hemagglutinin__InfluenzaA__ABD15680

SEQ ID NO: 61714 - RNA, 1701 nt, Artificial Sequence
  derived and/or modified sequence opt1 from hemagglutinin__InfluenzaA__ABD15691
augaagaccaucaucgcccugagcuacauccucugccugguguucgcccagaagcugcccgucaacgacaaguccaccgcgacgcucugccugggccaccacgccgugccgaacgggacccuggugaagaccaucaccaacgaccacaucgaggucacgaacgccaccgagcucgugcagagcucccccaccggccgcaucugcgacagcccccaccagauccuggacggggagaacugcacccugaucgacgcccuccugggcgacccccacugcgacggguuccagaacaaggagugggaccuguucguggagcgguccacggccuacagcaacugcuacccguacgacguccccgacuacgcgucccuccgcagccugguggccuccagcggcacccuggaguucaacaacgaguccuucaacuggaccggcguggcccagaacgggaccagcuccgccugcaagcggcgcagcaucaaguccuucuucagccggcucaacuggcugcaccagcugaaguacaaguaccccgcgcucaacgucacgaugcccaacaacgagaaguucgacaagcuguacaucuggggcgugcaccacccguccaccgacagcgaccagaucucccuguacgcccaggccagcgggcgcgugaccgucagcaccaagcggucccagcagacggugauccccaacaucggcagccgccccugggugcgcggggucuccagccggaucuccaucuacuggaccaucgugaagcccggcgacauccuccugaucaacagcaccggcaaccugaucgccccgcggggguacuucaagauccgcuccggcaagagcuccaucaugcggagcaacgcccccaucgggaagugcaacuccgagugcaucacccccaacggcagcauccccaacgacaagccguuccagaacgugaaccgcaucacguacggcgcgugcccccgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacuccgagggcacggggcaggccgcggaccucaagagcacccaggccgccaucaaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacaugggcaacggcugcuucaagaucuaccacaagugcgacaacgccugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggguucaucaugugggccugccagaagggcaacauccgcugcaacaucugcaucuga

SEQ ID NO: 61715 - RNA, 1701 nt, Artificial Sequence
  derived and/or modified sequence opt1 from hemagglutinin__InfluenzaA__ABD15702
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaccagccuguacgcccaggccccggggcgggugaccgugagcaccaagcgcucccagcagacggucauccccaacaucggcagccggcccugggugcgcggcguguccagccggaucuccaucuacuggaccaucgucaagcccggggacauccuccugaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucacguacggcgcgugcccgcgcuacgugaagcagaacacccucaagcuggccaccgggaugcggaacguccccgagaagcagacccgcggcaucuucggggccaucgccggcuucaucgagaacggcugggaggggaugguggacggcugguacggguuccggcaccagaacuccgagggcacggggcaggccgcggaccugaaguccacccaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacacgaucgaccugaccgacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 61716 - RNA, 1701 nt, Artificial Sequence
  derived and/or modified sequence opt1 from hemagglutinin__InfluenzaA__ABD15724
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacguggccaugcccaacaacgagaaguucgacaagcuguacaucuggggcguccaccaccccagcaccgacuccgaccagaucagccuguacgcccaggccccggggcgggugacggugagcaccaagcgcucccagcagaccgucauccccaacaucggcagccggcccugggugcgcggcguguccagccggaucuccaucuacuggaccaucgucaagcccggggacauccuccugaucaacugcacgggcaaccugaucgccccgcgcggguacuucaagauccggagcggcaaguccagcaucaugcgcuccgacgcgagcaucggcaagugcaacuccgagugcaucacccccaacgggagcauccccaacgacaagcccuuccagaacgugaaccggaucaccuacggcgccugcccgcgcuacgugaagcagaacacccucaagcuggccacggggaugcggaacguccccgagaagcagacccgcggcaucuucggggccaucgccggcuucaucgagaacggcugggaggggaugguggacggcugguacggguuccggcaccagaacuccgagggcaccgggcaggcggccgaccugaaguccacccaggccgccaucaaccagaucaacggcaagcucaaccgccugaucgagaagacgaacgagaaguuccaccagaucgagaaggaguucuccgagguggagggccggauccaggaccuggagaaguacgucgaggacaccaagaucgaccucuggagcuacaacgccgagcugcugguggcgcucgagaaccagcacaccaucgaccugaccgacuccgagaugaacaagcuguucgagcgcacgaagaagcagcuccgggagaacgccgaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggcgugccagaaggggaacauccgcugcaacaucugcaucuga

SEQ ID NO: 61717 - RNA, 1701 nt, Artificial Sequence
  derived and/or modified sequence opt1 from hemagglutinin__InfluenzaA__ABD15746
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgggggaucagcucccgcaucagcaucuacuggaccaucgucaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgugaagcagaacacccucaagcuggccaccgggaugcgcaacguccccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggagaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggguucaucaugugggccugccagaagggcaacauccgcugcaacaucugcaucuga

SEQ ID NO: 61718 - RNA, 1701 nt, Artificial Sequence
  derived and/or modified sequence opt1 from hemagglutinin__InfluenzaA__ABD15757
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggagaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61719 - RNA, 1701 nt, Artificial Sequence; identical to SEQ ID NO: 61658
  derived and/or modified sequence opt1 from hemagglutinin__InfluenzaA__ABD15779

SEQ ID NO: 61720 - RNA, 1701 nt, Artificial Sequence; identical to SEQ ID NO: 61658
  derived and/or modified sequence opt1 from hemagglutinin__InfluenzaA__ABD15790

SEQ ID NO: 61721 - RNA, 1701 nt, Artificial Sequence; identical to SEQ ID NO: 61658
  derived and/or modified sequence opt1 from hemagglutinin__InfluenzaA__ABD16292

SEQ ID NO: 61722 - RNA, 1701 nt, Artificial Sequence; identical to SEQ ID NO: 61641
  derived and/or modified sequence opt1 from hemagglutinin__InfluenzaA__ABD16303

SEQ ID NO: 61723 - RNA, 1701 nt, Artificial Sequence; identical to SEQ ID NO: 61641
  derived and/or modified sequence opt1 from hemagglutinin__InfluenzaA__ABD16325

SEQ ID NO: 61724 - RNA, 1701 nt, Artificial Sequence
  derived and/or modified sequence opt1 from hemagglutinin__InfluenzaA__ABD16336
augaagaccaucaucgcccugagcuacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagagcuccagcaccgggggcaucugcgacagcccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacccuggaguucaacaacgagagcuucaacuggaccggcgucacccagaacgggacguccagcgccugcaagcgccgguccaacagcuccuucuucagccgccugaacuggcucacccaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucacggucagcaccaagcgcucccagcagaccgugaucccgaacaucggcagccggccccgcgugcgggacauccccucccgcaucagcaucuacuggaccaucgucaagcccggggacauccugcucaucaacuccacgggcaaccugaucgccccgcggggguacuucaagauccgcagcggcaaguccagcaucaugcgguccgacgcccccaucggcaagugcaacagcgagugcaucacccccaacggguccauccccaacgacaagccguuccagaacgugaaccgcaucaccuacggcgccugcccccgguacgugaagcagaacacccugaagcucgcgacggggaugcgcaacguccccgagaagcagacccggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 61725 - RNA, 1701 nt, Artificial Sequence; identical to SEQ ID NO: 61641
  derived and/or modified sequence opt1 from hemagglutinin__InfluenzaA__ABD16347

SEQ ID NO: 61726 - RNA, 1701 nt, Artificial Sequence
  derived and/or modified sequence opt1 from hemagglutinin__InfluenzaA__ABD16358
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgaccuggagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggcuacaaggacuggauccucuggaucagcuucgccaucuccugcuuccugcugugcguggcccuccugggguucaucaugugggccugccagaagggcaacauccggugcaacaucugcaucuga

SEQ ID NO: 61727 - RNA, 1701 nt, Artificial Sequence; identical to SEQ ID NO: 61641
  derived and/or modified sequence opt1 from hemagglutinin__InfluenzaA__ABD16472

SEQ ID NO: 61728 - RNA, 1701 nt, Artificial Sequence; identical to SEQ ID NO: 61641
  derived and/or modified sequence opt1 from hemagglutinin__InfluenzaA__ABD16483

SEQ ID NO: 61729 - RNA, 1701 nt, Artificial Sequence; identical to SEQ ID NO: 61638
  derived and/or modified sequence opt1 from hemagglutinin__InfluenzaA__ABD16494

SEQ ID NO: 61730 - RNA, 1701 nt, Artificial Sequence; identical to SEQ ID NO: 61641
  derived and/or modified sequence opt1 from hemagglutinin__InfluenzaA__ABD16505

SEQ ID NO: 61731 - RNA, 1701 nt, Artificial Sequence
  derived and/or modified sequence opt1 from hemagglutinin__InfluenzaA__ABD16516
augaagaccaucaucgcccugagcuacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucaucgagcgcuccaaggccuacuccaacugcuaccccuacgacgugccggacuacgcgagccugcggucccugguggccagcuccgggacgcucgaguucaacaacgagagcuucaacuggaccggcgucacccagaacgggaccuccagcgccugcaagcgccgguccaacaacagcuucuucucccgccugaacuggcugacgcaccucaaguucaaguaccccgcccugaacgugaccaugcccaacaacgagaaguucgacaagcuguacaucuggggcgugcaccaccccgggaccgacaacgaccagaucagccucuacgcgcaggccuccggccggaucaccgucagcacgaagcgcagccagcagaccgugaucccgaacaucggcucccggccccgcgugcgggacauccccagccgcaucuccaucuacuggaccaucgucaagcccggggacauccugcugaucaacagcaccggcaaccucaucgccccgcggggguacuucaagauccgcuccggcaagagcuccaucaugcggagcgacgcccccaucgacaagugcaacuccgagugcaucacgcccaacggcagcauccccaacgacaagccguuccagaacgugaaccgcaucaccuacggggccugcccccgguacgugaagcagaacacccugaagcuggcgaccggcaugcgcaacguccccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccucgagaaguacgucgaggacaccaagguggaccuguggagcuacaacgccgagcugcucguggcccuggagaaccagcacacgaucgaccugaccgacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 61732 - RNA, 1701 nt, Artificial Sequence
  derived and/or modified sequence opt1 from hemagglutinin__InfluenzaA__ABD16527
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgggaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggaccacgcgagccugcggucccucgucgccagcuccggcacgcuggaguucaacaacgagagcuucgacuggaccggggugacccagaacggcaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcgggcggaucaccgugagcacgaagcgcucccagcagaccgugaucccgaacaucggcagccggccccgcguccgggacguguccagccgcaucuccaucuacuggaccaucgugaagcccggcgacauccugcucaucaacagcaccgggaaccugaucgcgccccggggcuacuucaagauccgcuccgggaaguccuccaucaugcggagcgacgccccgaucggcaagugcaacuccgagugcaucacgcccaacggcagcauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaaggggguggagcugaaguccggcuacaaggacuggauccuguggaucagcuucgccaucagcugcuuccuccugugcgucgcccugcucggcuucaucaugugggccugccagaaggggaacauccggugcgacaucugcaucuga

SEQ ID NO: 61733 - RNA, 1701 nt, Artificial Sequence; identical to SEQ ID NO: 61524
  derived and/or modified sequence opt1 from hemagglutinin__InfluenzaA__ABD16538

SEQ ID NO: 61734 - RNA, 1701 nt, Artificial Sequence
  derived and/or modified sequence opt1 from hemagglutinin__InfluenzaA__ABD16549
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucgugugggccugccagaagggcaacauccggugcaacaucugcaucuga

SEQ ID NO: 61735 - RNA, 1701 nt, Artificial Sequence; identical to SEQ ID NO: 61638
  derived and/or modified sequence opt1 from hemagglutinin__InfluenzaA__ABD16560

SEQ ID NO: 61736 - RNA, 1701 nt, Artificial Sequence
  derived and/or modified sequence opt1 from hemagglutinin__InfluenzaA__ABD16571
augaagaccaucaucgcccugagcuacaucuucugccucguggucgcccagaagcugcccggcaacgacaacuccaccgcgacgcugugccucgggcaccacgccgugccgaacggcaccaucgugaagaccaucaccaacgaccagaucgaggucacgaacgccaccgagcuggugcagagcuccagcaccgggcgcaucugcaacagcccccaccggauccuggacggcaagaacugcacccucaucgacgcccugcugggggacccccacugcgacuccuuccagaacaaggagugggaccucuucguggagcgcuccaaggccuacagcaacugcuaccccuacgacgucccggacuacgcgucccugcggagccugguggccuccagcggcacgcucgaguucaucaacgaggacuucaacuggaccggcguggcccaguccgggggcagcuacgccugcaagcgcggguccgucaacagcuucuucucccggcugaacuggcugcacgagagcgaguacaaguaccccgcgcucaacgugaccaugcccaacaacggcaaguucgacaagcuguacaucuggggcgugcaccaccccuccaccgaccgcgagcagacgaaccuguacguccgggccagcgggcgcgugaccgugagcaccaagcggucccagcagaccgucaucccgaacaucggcagccgccccugggugcgggggcucuccagccgcaucuccaucuacuggacgaucgugaagcccggcgacauccugcugaucaacagcaccgggaaccucaucgcgccccggggcuacuucaagauccgcaccggcaaguccagcaucaugcgguccgacgccccgaucgggaccugcagcuccgagugcaucacgcccaacggcagcauccccaacgacaagcccuuccagaacgucaaccgcaucaccuacggggccugcccgcgguacgugaagcagaacacccugaagcuggccaccggcaugcgcaacgugcccgagaagcagacgcgggggaucuucggcgccaucgccggcuucaucgagaacgggugggagggcauggucgacgggugguacggcuuccgccaccagaacuccgaggggaccggccaggccgccgaccucaagagcacccaggcggccaucgaccagaucaacggcaagcugaaccggcugaucgagaagaccaacgagaaguuccaccagaucgagaaggaguucuccgagguggaggggcgcauccaggaccucgagaaguacguggaggacacgaagaucgaccuguggagcuacaacgccgagcugcucgucgcccuggagaaccagcacaccaucgaccugaccgacuccgagaugaacaagcuguucgagaagacccgcaagcagcuccgggagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcgucgagcucaaguccggcuacaaggacuggauccuguggaucagcuucgccaucagcugcuuccugcucugcguggugcugcugggguucaucaugugggccugccagaagggcaacauccggugcaacaucugcaucuga

SEQ ID NO: 61737 - RNA, 1701 nt, Artificial Sequence
  derived and/or modified sequence opt1 from hemagglutinin__InfluenzaA__ABD16718
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucaucgagcgcagcaaggccuucuccaacugcuaccccuacgacgugccggacuacgcgagccugcggucccucguggccagcuccggcacgcuggaguucaucaacgagggguucaacuggaccggcgucacccagagcgggggcuccuacgccugcaagcgcgggagcgugaacuccuucuucagccggcugaacuggcucuacgaguccgaguacaaguaccccgcccugaacgugaccaugcccaacaacggcaaguucgacaagcuguacaucuggggcguccaccaccccaucacggagaaggagcagaccaaccucuacgugcgcgcgagcgggcgggugaccgucuccaccaagcgcagccagcagacggugaucccgaacaucggcagccggcccugggugcgcgggcuguccagccggaucuccaucuacuggaccaucgucaagcccggcgacauccugcucaucaacagcaccggcaaccugaucgcgccccgcggguacuucaagauccggaccggcaaguccagcaucaugcgcuccgacgccccgaucgggacgugcagcuccgagugcaucacccccaacggcagcauccccaacgacaagcccuuccagaacgugaacaagaucaccuacggggccugcccgcgguacgugaagcagaacacccugaagcucgccacgggcaugcgcaacguccccgagaagcagacccggggcaucuucggggccaucgccggcuucaucgagaacgggugggagggcaugguggacgggugguacggcuuccgccaccagaacuccgagggcaccgggcaggccgccgaccugaaguccacccaggccgcgaucgaccagaucaacggcaagcugaaccggcucaucgagaagacgaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgcggaagcagcugcgcgagaacgccgaggacaugggcaacgggugcuucaagaucuaccacaagugcgacaacgccugcaucggcagcauccgcaacggcaccuacgaccacgacguguaccgggacgaggcgcucaacaaccgcuuccagaucaagggggucgagcugaaguccggcuacaaggacuggauccuguggaucagcuucgccaucuccugcuuccuccugugcgugguccugcucggguucaucaugugggccugccagaagggcaacauccggugcaacaucugcaucuga

SEQ ID NO: 61738 - RNA, 1701 nt, Artificial Sequence
  derived and/or modified sequence opt1 from hemagglutinin__InfluenzaA__ABD16729
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgagggguucaacuggaccggcgugacccagaacgggggcagcuacacgugcaagcgcggguccgugaacagcuucuucucccggcugaacuggcucuacgagagcgaguccaaguaccccguccugaacgugaccaugcccaacaacggcaaguucgacaagcuguacaucuggggcgugcaccaccccagcaccgacaaggagcagaccaaccucuacguccgcgccuccgggaaggugaccgugagcacgaagcggagccagcagaccgucaucccgaacaucggcucccgccccugggugcgggggcugagcucccgcaucagcaucuacuggaccaucgugaagcccggcgacauccugcucaucaacuccaccggcaaccugaucgcgccccggggguacuucaagauccgcacgggcaagagcuccaucaugcggagcgacgccccgaucgggaccugcuccagcgagugcaucacccccaacggcuccauccccaacgacaagcccuuccagaacgucaacaagaucaccuacggggccugcccgcgcuacgugaagcagaacacgcugaagcucgccaccggcaugcggaacgugcccgagaagcagacccgcggcaucuucggggccaucgccggcuucaucgagaacgggugggagggcauggucgacgggugguacggcuuccggcaccagaacagcgagggcaccgggcaggcggccgaccugaaguccacgcaggccgccaucgaccagaucaacggcaagcugaaccgccucaucgagaagaccaacgagaaguuccaccagaucgagaaggaguucagcgagguggaggggcggauccaggaccuggagaaguacguggaggacaccaagaucgaccugugguccuacaacgccgagcuccuggucgcgcuggagaaccagcacaccaucgaccucacggacagcgagaugaacaagcuguucgagaagacccgcaagcagcugcgggagaacgccgaggacaugggcaacgggugcuucaagaucuaccacaagugcgacaacgccugcaucggcuccauccgcaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggugcugcucggguucaucaugugggcgugccagaagggcaacauccgcugcaacaucugcaucuga

SEQ ID NO: 61739 - RNA, 1701 nt, Artificial Sequence
  derived and/or modified sequence opt1 from hemagglutinin__InfluenzaA__ABD16751
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccacagcuccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcuccagcgccugcaagcgggggcccgacaacggcuucuucucccgccugaacuggcucuacaagagcggcuccaccuaccccgugcagaacgucacgaugcccaacaacgacaacagcgacaagcuguacaucuggggcgugcaccacccguccaccgacaaggagcagaccgaccuguacgugcaggccagcgggaaggucaccguguccacgaagcggagccagcagaccgugauccccaacgucgggagccgccccugggugcggggccucuccagccgcguguccaucuacuggaccaucgucaagcccggcgacauccuggugaucaacagcaacgggaaccugaucgcgccgcggggcuacuucaagaugcgcaccgggaaguccagcaucaugcgguccgacgcccccaucggcacgugcagcuccgagugcaucacccccaacgggagcauccccaacgacaagccguuccagaacgugaacaagaucaccuacggcgccugccccaaguacgucaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggugaucgagaagacgaacgagaaguuccaccagaucgagaaggaguucuccgaggucgagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcagcauccgcaacgggaccuacgaccacgacguguaccgggacgaggcccucaacaaccgcuuccagaucaagggcguggagcugaaguccggguacaaggacuggauccuguggaucagcuucgcgaucuccugcuuccuccugugcgucgugcugcucggcuucaucaugugggccugccagaagggcaacauccgcugcaacaucugcaucuga

SEQ ID NO: 61740 - RNA, 1701 nt, Artificial Sequence; identical to SEQ ID NO: 61601
  derived and/or modified sequence opt1 from hemagglutinin__InfluenzaA__ABD16762

SEQ ID NO: 61741 - RNA, 1701 nt, Artificial Sequence; identical to SEQ ID NO: 61313
  derived and/or modified sequence opt1 from hemagglutinin__InfluenzaA__ABD17323

SEQ ID NO: 61742 - RNA, 1701 nt, Artificial Sequence; identical to SEQ ID NO: 61570
  derived and/or modified sequence opt1 from hemagglutinin__InfluenzaA__ABD38134

SEQ ID NO: 61743 - RNA, 1698 nt, Artificial Sequence; identical to SEQ ID NO: 61309
  derived and/or modified sequence opt1 from hemagglutinin__InfluenzaA__ABD60779

SEQ ID NO: 61744 - RNA, 1701 nt, Artificial Sequence
  derived and/or modified sequence opt1 from hemagglutinin__InfluenzaA__ABD60790
augaagaccaucaucgcccugagcuacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccagcaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccagcgggacccuggaguucaucaacgagggcuucaccuggaccggggugacgcagaacggcggguccaacgccugcaagcggggccccgacagcggcuucuucucccgccugaacuggcucuacaagagcggguccaccuaccccgugcugaacgucaccaugcccaacaacgacaacuucgacaagcuguacaucuggggcgugcaccacccgagcaccgaccaggagcagacgucccucuacgugcaggccagcgggcgggucaccguguccaccaagcgcagccagcagaccaucauccccaacaucggcagccggcccugggugcgcggccuguccagccggaucuccaucuacuggacgaucgucaagcccggggacauccugaucaucaacagcaacggcaaccucaucgccccgcgcggguacuucaagaugcggaccggcaaguccagcaucaugcgcuccgacgcgcccaucgggaccugcaucagcgagugcaucacccccaacggcuccauccccaacgacaagccguuccagaacgugaacaagaucacguacggcgccugccccaaguacgugaagcagaacacccugaagcuggccaccgggaugcggaacguccccgagaagcagacccgcggcaucuucggggccaucgccggcuucaucgagaacgggugggagggcaugaucgacggcugguacggguuccggcaccagaacagcgagggcacggggcaggcggccgaccucaaguccacccaggccgccaucgaccagaucaacggcaagcugaaccgcaucaucgagaagaccaacgagaaguuccaccagaucgagaaggaguucagcgagguggaggggcggauccaggaccuggagaaguacguggaggacaccaagaucgaccucugguccuacaacgccgagcugcuggucgcgcucgagaaccagcacacgaucgaccugaccgacagcgagaugaacaagcuguucgagaagacccgccggcagcuccgcgagaacgccgaggacaugggcaacggcugcuucaagaucuaccacaagugcgacaacgccugcaucggguccauccggaacggcaccuacgaccacgacguguaccgcgacgaggcccugaacaaccgcuuccagaucaaggggguggagcucaagagcggcuacaaggacuggauccuguggaucuccuucgccaucagcugcuuccugcugugcgucgugcuccugggcuucaucaugugggcgugccagaaggggaacauccggugcaacaucugcaucuga

SEQ ID NO: 61745 - RNA, 1701 nt, Artificial Sequence
  derived and/or modified sequence opt1 from hemagglutinin__InfluenzaA__ABD60801
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgccugugcgacagcccccaccggauccuggacggcaagaacugcacccucaucgacgcccugcugggggacccccacugcgacggcuuccagaacaaggagugggaccucuucguggagcgcagcaaggccuacuccaacugcuaccccuacgacgugccggacuacgcgagccugcggucccuggucgccagcuccggcacgcucgaguucaucaacgaggacuucaacuggaccgggguggcccaggacggcgggagcuacgccugccgccggggcuccgugaacagcuucuucucccgccugaacuggcugcacaagcucgaguacaaguaccccgcgcugaacgucaccaugcccaacaacgggaaguucgacaagcuguacaucuggggcgugcaccaccccagcaccgacuccgaccagacgagccucuacgugcgggccuccggccgcgucaccgugagcaccaagcggagccagcagaccgugaucccgaacaucgggucccgccccuggguccggggccagagcucccgcaugagcaucuacuggacgaucgugaagcccggggacauccugcugaucaacuccaccggcaaccucaucgcgccccggggcuacuucaagauccgcaacgggaaguccuccaucaugcggagcgacgccccgaucggcaacugcuccagcgagugcaucacccccaacggguccauccccaacgacaagcccuuccagaacgugaaccgcaucaccuacggcgccugcccgcgguacgucaagcagcacacgcugaagcuggccaccgggaugcgcaacgugcccgagaagcagacccggggcaucuucggcgccaucgccggguucaucgagaacggcugggaggggaugguggacggcugguacggguuccgccaccagaacagcgagggcaccggccaggccgccgaccucaaguccacgcaggcggccaucgaccagaucaacgggaagcugaaccggcugaucgagaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacaccaucgaccugacggacagcgagaugaacaagcuguucgagcgcacccggaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 61746 - RNA, 1701 nt, Artificial Sequence
  derived and/or modified sequence opt1 from hemagglutinin__InfluenzaA__ABD60812
augaagaccaucaucgcccugagcuacauccucugccugaucuucgcccagaagcugcccggcaacgacaacuccaccgcgacgcucugccuggggcaccacgccgugccgaacggcaccaucgucaagaccaucaccaacgaccagaucgaggugacgaacgccaccgagcuggugcagagcuccagcaccgggggcaucugcgacagcccccaccagauccucgacggggagaacugcacccugaucgacgcccugcucggcgacccccagugcgacggcuuccagaacaagaagugggaccuguucgucgagcgcagcaaggccuacuccaacugcuaccccuacgacgugccggacuacgcgagccugcggucccucguggccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucuuccuguacgcgcaggccagcggccggaucaccgucuccacgaagcgcagccagcagaccgugaucccgagcaucggcucccggccccgcgugcggaacauccccagccgcaucuccaucuacuggaccaucgucaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 61747 - RNA, 1701 nt, Artificial Sequence; identical to SEQ ID NO: 61641
  derived and/or modified sequence opt1 from hemagglutinin__InfluenzaA__ABD60823

SEQ ID NO: 61748 - RNA, 1701 nt, Artificial Sequence
  derived and/or modified sequence opt1 from hemagglutinin__InfluenzaA__ABD60845
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggaccagaacgggaccuccagcgccugcaagcggcgcuccacgaaguccuucuucucccggcucaacuggcugcaccagcugaaguacaaguaccccgcccucaacgucaccaugcccaacaacgagaaguucgacaagcuguacaucuggggcgugcaccaccccagcaccgacuccgaccagaucagccuguacgcgcaggccagcgggcgcgugaccgucuccacgaagcggagccagcagaccgugaccccgaacaucggcucccgccccugggugcgcggggucagcucccggaucagcaucuacuggaccaucgugaagcccggcgacauccuccugaucaacuccacgggcaaccugaucgcgccccggggguacuucaagauccgcagcggcaaguccagcaucaugcgguccaacgcccucaucgggaagugcaacagcgagugcaucaccccgaacggcuccauccccaacgacaagcccuuccagaacgugaaccgcaucaccuacggcgccugcccccgguacgucaagcagaacacccugaagcuggccacggggaugcgcaacgugccggagaagcagacccggggcaucuucggggccaucgccggcuucaucgagaacgggugggagggcaugguggacggcugguacggguuccgccaccagaacagcgagggcaccgggcaggccgccgaccucaaguccacccaggcggccaucaaccagaucaacggcaagcugaaccggcugaucgagaagacgaacgagaaguuccaccagaucgagaaggaguucagcgaggucgaggggcgcauccaggaccucgagaaguacguggaggacaccaagaucgaccugugguccuacaacgccgagcugcucguggcccuggagaaccagcacaccaucgaccugaccgacagcgagaugaacaagcuguucgagcggacgcgcaagcagcuccgcgagaacgccgaggacaugggcaacggcugcuucaagaucuaccacaagugcgacaacgcgugcaucggguccauccggaacggcaccuacgaccacgacgucuaccgcgacgaggcccugaacaaccgguuccagaucaaggggguggagcucaagagcggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 61749 - RNA, 1698 nt, Artificial Sequence
  derived and/or modified sequence opt1 from hemagglutinin__InfluenzaA__ABD60878
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagaaggcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61750 - RNA, 1698 nt, Artificial Sequence
  derived and/or modified sequence opt1 from hemagglutinin__InfluenzaA__ABD60889
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 61751 - RNA, 1698 nt, Artificial Sequence
  derived and/or modified sequence opt1 from hemagglutinin__InfluenzaA__ABD60900
augaaggugaagcgccugguccuccugugcaccuucaccgccacguacgccgacaccaucugcaucggcuaccacgcgaacaacagcaccgacaccguggacacggugcuggagaagaacgucaccgugacccacuccgugaaccuccuggaggacagccacaacgggaagcugugccuccugaagggcaucgcgccccugcagcucgggaacugcuccgucgccggcuggauccuggggaacccggagugcgagcugcucaucagcaaggaguccuggagcuacaucguggagacccccaaccccgagaacggcacgugcuaccccggcuacuucgccgacuacgaggagcugcgggagcagcuguccagcguguccagcuucgagcgcuucgagaucuucccgaaggaguccagcuggcccaaccacaccgucaccgggguguccgccagcugcucccacaacggcaagagcuccuucuaccggaaccuccuguggcugaccgggaagaacggccucuaccccaaccugagcaaguccuacgccaacaacaaggagaaggaggugcugguccucuggggcgugcaccacccgcccaacaucggggaccagaaggcccuguaccacacggagaacgccuacgugagcgucgugagcucccacuacagccgccgguucacccccgagaucgccaagcgccccaaggugcgggaccaggagggccgcaucaacuacuacuggacccugcucgagcccggggacaccaucaucuucgaggcgaacggcaaccugaucgccccgcgguacgccuucgcccugucccgcggguucggcagcggcaucaucacguccaacgcccccauggacgagugcgacgcgaagugccagacgccccagggggccaucaacagcucccuccccuuccagaacguccacccggugaccaucggcgagugccccaaguacgugcggagcgccaagcugcgcauggucaccgggcugcggaacauccccuccauccagagccgcggccucuucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccugaacaagaaggucgacgacggcuuccucgacaucuggaccuacaacgccgagcugcuggugcuccuggagaacgagcggacccuggacuuccacgacagcaacgugaagaaccucuacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcacgguggccagcucccuggugcuccuggucagccugggggccaucuccuucuggaugugcagcaacggcucccuccagugccggaucugcaucuga

SEQ ID NO: 61752 - RNA, 1698 nt, Artificial Sequence
  derived and/or modified sequence opt1 from hemagglutinin__InfluenzaA__ABD60911
augaaggccaagcugauggugcuccugugcaccuucaccgccacguacgcggacaccaucugcaucggcuaccacgccaacaacagcaccgacaccgucgacacggugcuggagaagaacgugaccgucacccacuccgugaaccuccuggaggacagccacaacgggaagcugugccuccugaagggcaucgcgccccugcagcucgggaacugcuccguggccggcuggauccuggggaacccggagugcgagcugcucaucagcaaggaguccuggagcuacaucgucgagacccccaaccccgagaacggcacgugcuaccccggcuacuucgccgacuacgaggagcugcgcgagcagcuguccagcguguccagcuucgagcgguucgagaucuucccgaaggaguccagcuggcccaaccacaccgugaccggggucuccgccagcugcucccacaacggcaagagcuccuucuaccgcaaccuccuguggcugaccgggaagaacggccucuaccccaaccugagcaaguccuacgccaacaacaaggagaaggaggugcuggugcucuggggcguccaccacccgcccaacaucggggaccagcgggcccuguaccacacggagaacgccuacgugagcguggucagcucccacuacagccgccgguucacccccgagaucgcgaagcgccccaaggugcgggaccaggagggccgcaucaacuacuacuggacccugcucgagcccggggacaccaucaucuucgaggccaacggcaaccugaucgccccgugguacgccuucgcccugucccggggguucggcagcggcaucaucacguccaacgcgcccaugggggagugcgacgccaagugccagacgccccagggcgccaucaacagcucccuccccuuccagaacgugcacccggucaccaucggggagugccccaaguacgugcgcagcgccaagcugcggauggugaccggccugcgcaacauccccuccauccagagccggggccucuucggggccaucgcgggcuucaucgagggcggguggaccgggauggucgacggcugguacggguaccaccaccagaacgagcagggcuccggcuacgccgccgaccagaaguccacccagaacgccaucgacgggaucaccaacaaggugaacagcaucaucgagaagaugaacacccaguucacggccgugggcaaggaguucaacaagcuggagcgccggauggagaaccugaacaagaaggucgacgacggguuccucgacaucuggaccuacaacgcggagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacaacgagugcauggagagcgugaagaacggcaccuacgacuaccccaaguacuccgaggagagcaagcugaaccgggagaagaucgacggcgucaagcucgaguccauggggguguaccagauccuggccaucuacagcacgguggccagcucccugguccuccuggugagccugggcgccaucuccuucuggaugugcagcaacgggucccuccagugccgcaucugcaucuga

SEQ ID NO: 61753 - RNA, 1701 nt, Artificial Sequence; identical to SEQ ID NO: 61040
  derived and/or modified sequence opt1 from hemagglutinin__InfluenzaA__ABD60922

SEQ ID NO: 61754 - RNA, 1701 nt, Artificial Sequence
  derived and/or modified sequence opt1 from hemagglutinin__InfluenzaA__ABD60933
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucgugagcaagaaguccuggagcuacaucgccgagacccccaacuccgagaacgggaccugcuaccccggcuacuucgccgacuacgaggagcugcgggagcagcugagcuccgucagcuccuucgagcgcuucgagaucuuccccaaggagcggagcuggccgaagcacaacgugacccgcggcgugacggccuccugcagccacaagggcaaguccagcuucuaccggaaccuccuguggcugaccgagaagaacggguccuaccccaaccucagcaagagcuacgucaacaacaaggagaaggaggugcuggugcuguggggcguccaccaccccuccaacaucgaggaccagaagaccaucuaccgcaaggagaacgccuacgugagcguggucuccagcaacuacaaccggcgcuucacccccgagaucgcggagcggccgaaggugcgcgggcaggccggccggaucaacuacuacuggacgcuccuggagcccggcgacaccaucaucuucgaggccaacgggaaccugaucgcccccuggcacgccuucgcgcucaaccgcggcuucggguccggcaucaucaccagcaacgccuccauggacgagugcgacaccaagugccagacgccccagggcgccaucaacagcucccugccguuccagaacauccaccccgugaccaucggggagugccccaaguacguccggagcaccaagcugcgcauggugaccggccuccggaacauccccuccauccagagccgcgggcuguucggcgccaucgccggguucaucgagggcggcuggacggggaugaucgacggcugguacggguaccaccaccagaacgagcagggcuccggguacgcggccgaccagaaguccacccagaacgccaucaacggcaucaccaacaaggugaacagcgucaucgagaagaugaacacccaguucacggccgugggcaaggaguucaacaagcuggagaagcggauggagaaccucaacaagaagguggacgacggguuccuggacaucuggaccuacaacgccgagcugcucguccugcuggagaacgagcgcacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuacccgaaguacuccgaggagagcaagcucaaccgggagaagaucgacggggugaagcuggagagcaugggcgucuaccagauccuggccaucuacuccacgguggccagcucccucgugcugcuggucagccucggcgccaucuccuucuggaugugcagcaacgggucccugcagugccgcaucugcaucuga

SEQ ID NO: 61755 - RNA, 1701 nt, Artificial Sequence
  derived and/or modified sequence opt1 from hemagglutinin__InfluenzaA__ABD60944
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagcggagcuggccgaagcacaacgucacccgcggcgugacggccuccugcagccacaagggcaaguccagcuucuaccggaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccgcaaggagaacgccuacgucagcgugguguccagcaacuacaaccggcgcuucacccccgagaucgcggagcggccgaagguccgcgggcaggccggccggaucaacuacuacuggacgcuccuggagcccggcgacaccaucaucuucgaggccaacgggaaccugaucgcccccugguacgccuucgcgcucucccgcggcuucgggagcggcaucaucaccuccaacgccagcauggacgagugcgacaccaagugccagacgccccagggcgccaucaacuccagccugccguuccagaacgugcaccccgugaccaucggggagugccccaaguacguccgguccaccaagcugcgcauggugaccggccuccggaacauccccagcauccagucccgcgggcuguucggcgccaucgccggguucaucgagggcggcuggacggggaugaucgacggcugguacggguaccaccaccagaacgagcagggcagcggguacgcggccgaccagaaguccacccagaacgccaucaacggcaucaccaacaaggugaacagcgucaucgagaagaugaacacccaguucacggccgugggcaaggaguucaacaagcuggagaagcggauggagaaccucaacaagaagguggacgacggguuccuggacaucuggaccuacaacgccgagcugcucguccugcuggagaacgagcgcacccucgacuuccacgacuccaacgugaagaaccuguacgagaaggucaagagccagcugaagaacaacgcgaaggagaucggcaacgggugcuucgaguucuaccacaagugcaacaacgagugcauggaguccgugaagaacggcaccuacgacuacccgaaguacagcgaggagagcaagcucaaccgggagaagaucgacggggugaagcuggaguccaugggcgucuaccagauccuggccaucuacagcacgguggccuccagccucgugcugcuggucucccucggcgccaucagcuucuggaugugcuccaacgggagccugcagugccgcaucugcaucuga

SEQ ID NO: 61756 - RNA, 1701 nt, Artificial Sequence
  derived and/or modified sequence opt1 from hemagglutinin__InfluenzaA__ABD60955
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccgaagugcgagagccuguucuccaaggagagcugguccuacaucgccgagacccccaaccccgagaacgggaccugcuaccccggcuacuucgccgacuacgaggagcuccgggagcagcugagcuccgucagcuccuucgagcgcuucgagaucuucccgaaggagagcuccuggcccaaccacacggugaccaagggggugaccaccagcugcucccacaacggcaagagcuccuucuaccggaaccugcucuggcugacggagaagaacgggcuguaccccaaccucagcaaguccuacgucaacaacaaggagaaggaggugcuggugcuguggggcguccaccaccccagcaacauccgcgaccagcgggccaucuaccacaccgagaacgccuacgugagcguggucuccagccacuacucccgccgguucaccccggagaucgcgaagcgccccaaggugcgggaccaggaggggcgcaucaacuacuacuggacccuccuggagcccggcgacacgaucaucuucgaggccaacggcaaccugaucgcccccugguacgccuucgcccucagccggggguucggcuccgggaucaucaccagcaacgcguccauggacgagugcgacgccaagugccagaccccgcagggcgccaucaacagcucccugcccuuccagaacgugcaccccgucaccaucggcgagugccccaaguacgugcgcagcacgaagcugcggauggugaccgggcuccgcaacaucccguccauccagagccggggccuguucggggccaucgccggcuucaucgagggcggcuggaccggcaugaucgacgggugguacggcuaccaccaccagaacgagcagggguccggcuacgcggccgaccagaaguccacccagaacgccaucaacgggaucacgaacaaggucaacagcgugaucgagaagaugaacacccaguucaccgccgugggcaaggaguucaacaagcuggagcgccggauggagaaccucaacaagaaggucgacgacggcuuccuggacaucuggaccuacaacgccgagcugcucgugcugcuggagaacgggcgcacgcucgacuuccacgacagcaacgucaagaaccuguacgagaaggugaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgggggaagaucgacggcgucaagcuggagagcaugggcguguaccagauccuggccaucuacuccaccguggccagcucccucguccugcuggugagccucggggccaucuccuucuggaugugcagcaacggcucccugcagugccgcaucugcaucuga

SEQ ID NO: 61757 - RNA, 1701 nt, Artificial Sequence; identical to SEQ ID NO: 61040
  derived and/or modified sequence opt1 from hemagglutinin__InfluenzaA__ABD61260

SEQ ID NO: 61758 - RNA, 1701 nt, Artificial Sequence; identical to SEQ ID NO: 61040
  derived and/or modified sequence opt1 from hemagglutinin__InfluenzaA__ABD61271

SEQ ID NO: 61759 - RNA, 1701 nt, Artificial Sequence; identical to SEQ ID NO: 61294
  derived and/or modified sequence opt1 from hemagglutinin__InfluenzaA__ABD61282

SEQ ID NO: 61760 - RNA, 1701 nt, Artificial Sequence; identical to SEQ ID NO: 61524
  derived and/or modified sequence opt1 from hemagglutinin__InfluenzaA__ABD61293

SEQ ID NO: 61761 - RNA, 1701 nt, Artificial Sequence; identical to SEQ ID NO: 61746
  derived and/or modified sequence opt1 from hemagglutinin__InfluenzaA__ABD61304

SEQ ID NO: 61762 - RNA, 1701 nt, Artificial Sequence; identical to SEQ ID NO: 61658
  derived and/or modified sequence opt1 from hemagglutinin__InfluenzaA__ABD61315

SEQ ID NO: 61763 - RNA, 1701 nt, Artificial Sequence; identical to SEQ ID NO: 61080
  derived and/or modified sequence opt1 from hemagglutinin__InfluenzaA__ABD61337

SEQ ID NO: 61764 - RNA, 1701 nt, Artificial Sequence
  derived and/or modified sequence opt1 from hemagglutinin__InfluenzaA__ABD61348
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacaacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61765 - RNA, 1701 nt, Artificial Sequence; identical to SEQ ID NO: 61080
  derived and/or modified sequence opt1 from hemagglutinin__InfluenzaA__ABD61359

SEQ ID NO: 61766 - RNA, 1701 nt, Artificial Sequence; identical to SEQ ID NO: 61718
  derived and/or modified sequence opt1 from hemagglutinin__InfluenzaA__ABD61370

SEQ ID NO: 61767 - RNA, 1701 nt, Artificial Sequence; identical to SEQ ID NO: 61658
  derived and/or modified sequence opt1 from hemagglutinin__InfluenzaA__ABD61381

SEQ ID NO: 61768 - RNA, 1701 nt, Artificial Sequence
  derived and/or modified sequence opt1 from hemagglutinin__InfluenzaA__ABD61392
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgcggcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgcgugaccgugagcaccaagcggucccagcagaccgucauccccaacaucggcagccgccccugggugcgcgggguguccagccggaucuccaucuacuggacgaucgucaagcccggcgacauccuccugaucaacugcaccgggaaccugaucgccccgcggggcuacuucaagauccgcagcggcaaguccagcaucaugcgguccgacgccagcaucgggaagugcaacuccgagugcaucacccccaacggcagcauccccaacgacaagcccuuccagaacgugaaccgcaucaccuacggggcgugcccgcgguacgugaagcagaacacgcucaagcuggccaccggcaugcgcaacguccccgagaagcagacccgggggaucuucggcgccaucgccggcuucaucgagaacgggugggagggcaugguggacgggugguacggcuuccgccaccagaacuccgaggggaccggccaggccgcggaccugaaguccacgcaggccgccaucaaccagaucaacggcaagcucaaccggcugaucgagaagaccaacgagaaguuccaccagaucgagaaggaguucuccgagguggaggggcgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgcuuccagaucaagggcgucgagcugaaguccggcuacaaggacuggauccucuggaucagcuucgccaucagcugcuuccugcugugcgugguccuccugggguucaucaugugggccugccagaagggcaacauccggugcaacaucugcaucuga

SEQ ID NO: 61769 - RNA, 1701 nt, Artificial Sequence; identical to SEQ ID NO: 61748
  derived and/or modified sequence opt1 from hemagglutinin__InfluenzaA__ABD61403

SEQ ID NO: 61770 - RNA, 1701 nt, Artificial Sequence
  derived and/or modified sequence opt1 from hemagglutinin__InfluenzaA__ABD61529
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgagggguucaacuggaccggcgugacccagagcgggggcuccuacgccugcaagcgcgggagcgugaacuccuucuucagccggcugaacuggcucuacgaguccgagagcaaguaccccguccugaacgugaccaugcccaacaacggcaaguucgacaagcuguacaucuggggcgugcaccaccccuccacggacaaggagcagaccaaccucuacguccgcgccagcgggcgggugaccgugagcaccaagcgcucccagcagacggucaucccgaacaucggcagccggcccugggugcgcgggcuguccagccggaucuccaucuacuggaccaucgugaagcccggcgacauccugcucaucaacagcaccggcaaccugaucgcgccccgcggguacuucaagauccggaccggcaaguccagcaucaugcgcuccgacgccccgaucgggacgugcagcuccgagugcaucacccccaacggcagcauccccaacgacaagcccuuccagaacgucaacaagaucaccuacggggccugcccgcgguacgugaagcagaacacccugaagcucgccacgggcaugcgcaacgugcccgagaagcagacccggggcaucuucggggccaucgcgggcuucaucgagaacgggugggagggcauggucgacgggugguacggcuuccgccaccagaacuccgagggcaccgggcaggccgccgaccugaaguccacccaggccgccaucgaccagaucaacggccggcugaaccgccucaucgagaagacgaacgagaaguuccaccagaucgagaaggaguucuccgagguggaggggcggauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcgcaagcagcugcgcgagaacgccgaggacaugggcaacgggugcuucaagaucuaccacaagugcgacaacgccugcaucggcagcauccggaacggcaccuacgaccacgacguguaccgcgacgaggcccucaacaaccgguuccagaucaagggggucgagcugaaguccggcuacaaggacuggauccuguggaucagcuucgcgaucagcugcuuccuccugugcguggugcugcucggguucaucaugugggccugccagaagggcaacauccgcugcaacaucugcaucuga

SEQ ID NO: 61771 - RNA, 1698 nt, Artificial Sequence; identical to SEQ ID NO: 61749
  derived and/or modified sequence opt1 from hemagglutinin__InfluenzaA__ABD61540

SEQ ID NO: 61772 - RNA, 1701 nt, Artificial Sequence
  derived and/or modified sequence opt1 from hemagglutinin__InfluenzaA__ABD61757
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcuccagcgccugcaagcgggggcccgacaacggcuucuucucccgccugaacuggcucuacaagagcggcuccaccuaccccgugcagaacgucacgaugcccaacaacgacaacagcgacaagcuguacaucuggggcgugcaccacccguccaccgacaaggagcagaccgaccuguacgugcaggccagcgggaaggucaccguguccacgaagcggagccagcagaccgugauccccaacgucgggagccgccccugggugcggggccucuccagccgcguguccaucuacuggaccaucgucaagcccggcgacauccuggugaucaacagcaacgggaaccugaucgcgccgcggggcuacuucaagaugcgcaccgggaaguccagcaucaugcgguccgacgcccccaucggcacgugcagcuccgagugcaucacccccaacgggagcauccccaacgacaagccguuccagaacgugaacaagaucaccuacggcgccugccccaaguacgucaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggugaucgagaagacgaacgagaaguuccaccagaucgagaaggaguucuccgaggucgagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcagcauccgcaacgggaccuacgaccacgacguguaccgggacgaggcccucaacaaccgcuuccagaucaagggcguggagcugaaguccggguacaaggacuggauccuguggaucagcuucgcgaucuccugcuuccuccugugcgucgugcugcucggcuucaucaugugggccugccagaagggcaacauccgcugcaacaucugcaucuga

SEQ ID NO: 61773 - RNA, 1701 nt, Artificial Sequence
  derived and/or modified sequence opt1 from hemagglutinin__InfluenzaA__ABD61777
augaagaccaucaucgcccugagcuacaucuucugccucggcuucgcccagaagcugcccgggaacgacaacuccaccgcgacgcugugccucggccaccacgccgugccgaacgggacccuggucaagaccaucaccaacgaccagaucgaggugacgaacgccaccgagcuggugcagagcuccagcaccggccgcaucugcgacagcccccaccggauccucgacgggaagaacugcacccugaucgacgcccugcucggcgacccccacugcgacggcuuccagaacgagaagugggaccuguucgucgagcgcagcaaggccuucuccaacugcuaccccuacgacgugccggacuacgcgagccugcggucccucguggccagcuccgggacgcuggaguucaucaacgagggcuucaacuggaccggggucacccagagcggcggguccuacgccugcaagcgcggcagcgugaacuccuucuucagccggcugaacuggcucuacgaguccgagagcaaguaccccgcccugaacgugaccaugcccaacaacggcaaguucgacaagcuguacaucuggggcguccaccaccccuccacggacaaggagcagaccaaccucuacgugcgcgcgagcgggcgggugaccgucagcaccaagcgcucccagcagacggugaucccgaacaucgggagccggcccugggugcgcggccuguccagccggaucuccaucuacuggaccaucgucaagcccggcgacauccugcucaucaacagcaccgggaaccugaucgcgccccgcggcuacuucaagauccggaccgggaaguccagcaucaugcgcuccgacgccccgaucggcacgugcagcuccgagugcaucacccccaacgggagcauccccaacgacaagcccuuccagaacgugaacaagaucaccuacggcgccugcccgcgguacgugaagcagaacacccugaagcucgccacgggcaugcgcaacguccccgagaagcagacccgggggaucuucggcgccaucgccggguucaucgagaacggcugggaggggaugguggacggcugguacggcuuccgccaccagaacuccgaggggaccggccaggccgccgaccugaaguccacccaggccgcgaucgaccagaucaacgggaagcugaaccggcucaucgagaagacgaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucaccgacuccgagaugaacaagcuguucgagaagacgcggaagcagcugcgcgagaacgccgaggacauggggaacggcugcuucaagaucuaccacaagugcgacaacgccugcaucggcagcauccgcaacgggaccuacgaccacgacguguaccgggacgaggcgcucaacaaccgcuuccagaucaagggcgucgagcugaaguccggguacaaggacuggauccuguggaucagcuucgccaucagcugcuuccuccugugcgugguccugcucggcuucaucaugugggccugccagaagggcaacauccggugcaacaucugcaucuga

SEQ ID NO: 61774 - RNA, 1701 nt, Artificial Sequence
  derived and/or modified sequence opt1 from hemagglutinin__InfluenzaA__ABD77598
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcucccccaccggccgcaucugcgacagcccccaccagauccuggacggggagaacugcacccugaucgacgcccuccugggcgacccccacugcgacggguuccagaacaaggagugggaccuguucguggagcgguccacggccuacagcaacugcuacccguacgacguccccgacuacgcgucccuccgcagccugguggccuccagcggcacccuggaguucaacaacgaguccuucaacuggaccggcguggcccagaacgggaccagcuccgccugcaagcggcgcagcaucaaguccuucuucagccggcucaacuggcugcaccagcugaaguacaaguaccccgcgcucaacgucacgaugcccaacaacgagaaguucgacaagcuguacaucuggggcgugcaccacccguccaccgacagcgaccagaucucccuguacgcccaggccagcgggcgcgugaccgucagcaccaagcggucccagcagacggugauccccaacaucggcagccgccccugggugcgcggggucuccagccggaucuccaucuacuggaccaucgugaagcccggcgacauccuccugaucaacagcaccggcaaccugaucgccccgcggggguacuucaagauccgcuccggcaagagcuccaucaugcggagcaacgcccccaucgggaagugcaacuccgagugcaucacccccaacggcagcauccccaacgacaagccguuccagaacgugaaccgcaucacguacggcgcgugcccccgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacuccgagggcacggggcaggccgcggaccucaagagcacccaggccgccaucaaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacaugggcaacggcugcuucaagaucuaccacaagugcgacaacgccugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggguucaucaugugggccugccagaagggcaacauccgcugcaacaucugcaucuga

SEQ ID NO: 61775 - RNA, 1701 nt, Artificial Sequence; identical to SEQ ID NO: 61658
  derived and/or modified sequence opt1 from hemagglutinin__InfluenzaA__ABD77609

SEQ ID NO: 61776 - RNA, 1701 nt, Artificial Sequence; identical to SEQ ID NO: 61658
  derived and/or modified sequence opt1 from hemagglutinin__InfluenzaA__ABD77620

SEQ ID NO: 61777 - RNA, 1701 nt, Artificial Sequence; identical to SEQ ID NO: 61658
  derived and/or modified sequence opt1 from hemagglutinin__InfluenzaA__ABD77631

SEQ ID NO: 61778 - RNA, 1701 nt, Artificial Sequence; identical to SEQ ID NO: 61658
  derived and/or modified sequence opt1 from hemagglutinin__InfluenzaA__ABD77642

SEQ ID NO: 61779 - RNA, 1701 nt, Artificial Sequence; identical to SEQ ID NO: 61658
  derived and/or modified sequence opt1 from hemagglutinin__InfluenzaA__ABD77653

SEQ ID NO: 61780 - RNA, 1698 nt, Artificial Sequence; identical to SEQ ID NO: 61749
  derived and/or modified sequence opt1 from hemagglutinin__InfluenzaA__ABD77708

SEQ ID NO: 61781 - RNA, 1698 nt, Artificial Sequence
  derived and/or modified sequence opt1 from hemagglutinin__InfluenzaA__ABD77719
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcggaaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 61782 - RNA, 1698 nt, Artificial Sequence; identical to SEQ ID NO: 61749
  derived and/or modified sequence opt1 from hemagglutinin__InfluenzaA__ABD77730

SEQ ID NO: 61783 - RNA, 1701 nt, Artificial Sequence; identical to SEQ ID NO: 61658
  derived and/or modified sequence opt1 from hemagglutinin__InfluenzaA__ABD77752

SEQ ID NO: 61784 - RNA, 1701 nt, Artificial Sequence; identical to SEQ ID NO: 61658
  derived and/or modified sequence opt1 from hemagglutinin__InfluenzaA__ABD77763

SEQ ID NO: 61785 - RNA, 1701 nt, Artificial Sequence
  derived and/or modified sequence opt1 from hemagglutinin__InfluenzaA__ABD77774
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgacaacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggaccagaacgggaccuccagcgccugcaagcggcgcuccaacaagagcuucuucucccggcucaacuggcugcaccagcugaaguacaaguaccccgcccucaacgucacgaugcccaacaacgagaaguucgacaagcuguacaucuggggcgugcaccaccccagcaccgacuccgaccagaucagccuguacgcgcaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccagaacggcuccauccccaacgacaagcccuuccagaacgugaaccgcaucacguacggcgccugcccccgguacgucaagcagaacacccucaagcuggccaccgggaugcgcaacgugccggagaagcagacccggggcaucuucggggccaucgccggcuucaucgagaacgggugggagggcaugguggacggcugguacggguuccgccaccagaacagcgagggcacggggcaggccgccgaccugaaguccacccaggcggccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgccgaggacaugggcaacggcugcuucaagaucuaccacaagugcgacaacgcgugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61786 - RNA, 1701 nt, Artificial Sequence; identical to SEQ ID NO: 61785
  derived and/or modified sequence opt1 from hemagglutinin__InfluenzaA__ABD77785

SEQ ID NO: 61787 - RNA, 1701 nt, Artificial Sequence
  derived and/or modified sequence opt1 from hemagglutinin__InfluenzaA__ABD77807
augaaggccaagcugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccgccugaagggcaucgcgccccuccagcuggggaagugcaacaucgccggcuggauccuggggaacccggagugcgagagccuccuguccaagcggagcugguccuacaucgccgagacccccaacagcgagaacgggaccugcuaccccggcgacuucgccgacuacgaggagcugcgcgagcagcucuccagcguguccagcuucgagcgguucgagaucuuccccaaggagcgcuccuggccgaagcacaacaucacccgcggggugacggccgccugcagccacgcgggcaaguccagcuucuacaagaaccugcuguggcucaccgagaccaacggguccuaccccaagcugagcaaguccuacgucaacaacaaggagaaggaggugcuggugcucuggggcguccaccaccccagcaacaucgaggaccagaagacccuguaccggaaggagaacgccuacgugagcguggucuccagcaacuacaaccggcgcuucacgcccgagaucgccgagcggccgaaggugcgcgggcaggccggccggaugaacuacuacuggacccugcucgagcccggcgacaccaucaucuucgaggccaacgggaaccugaucgcgcccugguacgccuucgcccugucccgcggcuucgggagcggcaucaucaccuccaacgccagcauggacgagugcgacacgaagugccagacgccccagggcgccaucaacuccagccucccguuccagaacauccaccccgugaccaucggggagugccccaaguacgucaaguccaccaagcugcggauggugaccggccugcgcaacauccccagcauccagucccggggccucuucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacagcgucaucgagaagaugaacacgcaguucaccgcggugggcaaggaguucaacaagcuggagaagcgcauggagaaccugaacaagaagguggacgacggguuccucgacaucuggaccuacaacgccgagcugcugguccuccuggagaacgagcggacccuggacuuccacgacuccaacgugaagaaccucuacgagaaggugaagaaccagcugcgcaacaacgccaaggagaucggcaacgggugcuucgaguucuaccacaagugcaacaacgagugcauggagagcgucaagaacggcacguacgacuacccgaaguacuccgaggagagcaagcugaaccgggagaagaucgacggggugaagcucgaguccaugggcgucuaccagauccuggccaucuacagcaccguggccagcucccuggugcuccuggucagccugggcgcgaucuccuucuggaugugcagcaacgggucccuccagugccgcaucugcaucuga

SEQ ID NO: 61788 - RNA, 1701 nt, Artificial Sequence
  derived and/or modified sequence opt1 from hemagglutinin__InfluenzaA__ABD77818
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagagcuccuggccgaagcacaccgucacgcgcggggugaccgccagcugcucccacaagggcaagagcuccuucuaccggaaccuccuguggcugaccgagaagaacgggagcuaccccaaccucagcaaguccuacgugaacaacaaggagaaggagguccuggugcuguggggcgugcaccaccccagcaacaucgaggaccagaagaccaucuaccggaaggagaacgccuacgucuccguggugagcucccacuacaaccgccgguucacgcccgagaucgcgaagcgcccgaagguccgggaccaggaggggcgcaucaacuacuacuggacccuccuggagcccggcgacaccaucaucuucgaggccaacggcaaccugaucgcccccugguacgccuucgcccucagccggggguucggcuccgggaucaucaccagcaacgcguccauggacgagugcgacgccaagugccagacgccccagggcgccaucaacagcucccugccguuccagaacgugcaccccgugaccaucggcgagugccccaaguacguccgcagcaccaagcugcggauggugaccgggcuccgcaacauccccuccauccagagccggggccuguucggggccaucgccggcuucaucgagggcggcuggacgggcaugaucgacgggugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagaagcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggucaagucccagcucaagagcaacgcgaaggagaucgggaacggcugcuucgaguucuaccacaagugcaacaacgagugcauggagagcgugaagaacgggaccuacgacuacccgaaguacuccgaggagagcaagcugaaccgcgagaagaucgacggcgugaagcuggaguccaugggggucuaccagauccuggccaucuacagcacgguggccuccagccucgugcugcuggucucccucggcgccaucagcuucuggaugugcuccaacggcagccugcagugccggaucugcaucuga

SEQ ID NO: 61789 - RNA, 1701 nt, Artificial Sequence
  derived and/or modified sequence opt1 from hemagglutinin__InfluenzaA__ABD77829
augaagaccaucaucgcccugagcuacauccucuaccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgccugugcgacagcccccaccggauccuggacggcaagaacugcacccucaucgacgcccugcugggggacccccacugcgacggcuuccagaacaaggagugggaccucuucguggagcgcagcaaggccuacuccgacugcuaccccuacgacgugccggacuacgcgagccugcggucccuggucgccagcuccggcacgcucgaguucaccaacgagggguucaacuggaccggcguggcccagaacgggaccagcuacgccugcaagcgcggcuccgugaaguccuucuucucccggcugaacuggcugcacaagcucgaguacaaguaccccgcgcugaacgucacgaugcccaacaacgacaaguucgacaagcuguacaucuggggcgugcaccaccccagcaccgacuccgaccagaccagccucuacgugcaggccuccgggcgcgucaccgugagcacgaagcggagccagcagaccgugaucccgaacaucggcucccgccccuggguccgcggggugagcucccggaucagcaucuacuggaccaucgugaagcccggcgacauccugcugaucaacuccaccgggaaccucaucgcgccccggggcuacuucaagauccgcagcggcaaguccagcaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccugaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccucaaguccacccaggcggccaucaaccagaucaacggcaagcugaaccggcugaucgagaagaccaacgagaaguuccaccagaucgagaaggaguucagcgagguggaggggcgcauccaggaccucgagaaguacguggaggacacgaagaucgaccugugguccuacaacgccgagcugcucgucgcccuggagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcucaagagcggcuacaaggacuggauccuguggaucuccuucgccaucagcugcuuccugcucugcguggugcugcugggguucaucaugugggccugccagaagggcaacauccgcugcaacaucugcaucuga

SEQ ID NO: 61790 - RNA, 1701 nt, Artificial Sequence
  derived and/or modified sequence opt1 from hemagglutinin__InfluenzaA__ABD77862
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccgacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccagcaucuacgugcaggccuccgggcgcgucaccgugagcacgaagcggagccagcagaccgugaucccgaacaucggcucccgccccuggguccgcggggugagcucccggaucagcaucuacuggaccaucgugaagcccggcgacauccugcucaucaacuccaccgggaaccugaucgcgccccggggcuacuucaagauccgcagcggcaaguccagcaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcugaaccggcucaucgagaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggacccgcaagcagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcgucgagcucaagagcggcuacaaggacuggauccuguggaucuccuucgccaucagcugcuuccugcugugcguggugcugcucggguucaucaugugggccugccagaagggcaacauccgcugcaacaucugcaucuga

SEQ ID NO: 61791 - RNA, 1701 nt, Artificial Sequence
  derived and/or modified sequence opt1 from hemagglutinin__InfluenzaA__ABD77884
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccaggggagcuccaccggccgcaucugcgacagcccccaccggauccuggacgggaagaacugcacccugaucgacgcccuccugggcgacccccacugcgacggcuuccagaacaaggagugggaccuguucguggagcgcuccaaggccuacagcaacugcuaccccuacgacgugccggacuacgcgucccuccggagccuggucgccuccagcgggacgcuggaguucaacaacgaguccuucaacuggaccggcguggcccagaacgggaccagcuacgccugcaagcgccgguccgucaagagcuucuucucccgccucaacuggcugcacaagcuggaguacaaguaccccgcgcucaacgugaccaugcccaacaacgacaaguucgacaagcuguacaucuggggcgugcaccaccccagcacggacuccgaccagaccagccuguacgugcaggccuccgggcgggucaccgugagcaccaagcgcagccagcagacggugaucccgaacaucggcucccggcccuggguccgcggcgugagcucccggaucagcaucuacuggaccaucgugaagcccggggacauccuccugaucaacuccaccggcaaccugaucgcgccccgcggguacuucaagauccggagcggcaaguccagcaucaugcgcuccgacgccccgaucgacaacugcaacagcgagugcaucacccccaacggcuccauccccaacgacaagcccuuccagaacgucaaccggaucacguacggggccugcccgcgcuacgugaagcagaacacccucaagcuggccaccggcaugcggaacgugcccgagaagcagacccgcgggaucuucggcgccaucgccggguucaucgagaacggcugggagggcauggucgacgggugguacggcuuccggcaccagaacagcgaggggacgggccaggccgccgaccugaaguccacccaggcggccaucaaccagaucaacgggaagcucaaccgccugaucgagaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacacgaucgaccugaccgacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggguacaaggacuggauccuguggaucuccuucgccaucagcugcuuccugcugugcguggugcuccugggcuucaucaugugggccugccagaagggcaacauccggugcaacaucugcaucuga

SEQ ID NO: 61792 - RNA, 1701 nt, Artificial Sequence
  derived and/or modified sequence opt1 from hemagglutinin__InfluenzaA__ABD77895
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccuacgccugcaagcgccggagcgugaaguccuucuucagccgccucaacuggcugcacaagcuggaguacaaguaccccgcgcucaacgucaccaugcccaacaacgacaaguucgacaagcuguacaucuggggcgugcaccaccccuccacggacagcgaccagaccucccuguacgugcaggccagcgggcgggucaccgugagcaccaagcgcucccagcagacggugaucccgaacaucgggagccggcccuggguccgcggcaucuccagccggaucuccaucuacuggaccaucgugaagcccggcgacauccuccugaucaacagcaccgggaaccugaucgcgccccgcggcuacuucaagauccgguccgggaaguccuccaucaugcgcagcgacgccccgaucgacaacugcaacuccgagugcaucacccccaacggcagcauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacuccgagggcacggggcaggccgccgaccucaagagcacccaggcggccaucaaccagaucuccggcaagcugaaccgccugaucgagaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccgcaagcagcuccgggagaacgccgaggacaugggcaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucagcuucgccaucuccugcuuccugcugugcgucgugcuccugggguucaucaugugggccugccagaagggcaacauccggugcaacaucugcaucuga

SEQ ID NO: 61793 - RNA, 1701 nt, Artificial Sequence; identical to SEQ ID NO: 61791
  derived and/or modified sequence opt1 from hemagglutinin__InfluenzaA__ABD77906

SEQ ID NO: 61794 - RNA, 1698 nt, Artificial Sequence
  derived and/or modified sequence opt1 from hemagglutinin__InfluenzaA__ABD77917
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagaaggcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61795 - RNA, 1698 nt, Artificial Sequence
  derived and/or modified sequence opt1 from hemagglutinin__InfluenzaA__ABD77928
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaagaaggugcucguccuguggggcgugcaccacccgcccaacaucggggaccagaaggcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61796 - RNA, 1698 nt, Artificial Sequence; identical to SEQ ID NO: 61750
  derived and/or modified sequence opt1 from hemagglutinin__InfluenzaA__ABD77939

SEQ ID NO: 61797 - RNA, 1698 nt, Artificial Sequence; identical to SEQ ID NO: 61750
  derived and/or modified sequence opt1 from hemagglutinin__InfluenzaA__ABD77950

SEQ ID NO: 61798 - RNA, 1698 nt, Artificial Sequence; identical to SEQ ID NO: 61749
  derived and/or modified sequence opt1 from hemagglutinin__InfluenzaA__ABD77961

SEQ ID NO: 61799 - RNA, 1698 nt, Artificial Sequence; identical to SEQ ID NO: 61750
  derived and/or modified sequence opt1 from hemagglutinin__InfluenzaA__ABD77983

SEQ ID NO: 61800 - RNA, 1698 nt, Artificial Sequence; identical to SEQ ID NO: 61750
  derived and/or modified sequence opt1 from hemagglutinin__InfluenzaA__ABD77994

SEQ ID NO: 61801 - RNA, 1698 nt, Artificial Sequence; identical to SEQ ID NO: 61749
  derived and/or modified sequence opt1 from hemagglutinin__InfluenzaA__ABD78005

SEQ ID NO: 61802 - RNA, 1698 nt, Artificial Sequence; identical to SEQ ID NO: 61749
  derived and/or modified sequence opt1 from hemagglutinin__InfluenzaA__ABD78016

SEQ ID NO: 61803 - RNA, 1698 nt, Artificial Sequence; identical to SEQ ID NO: 61750
  derived and/or modified sequence opt1 from hemagglutinin__InfluenzaA__ABD78027

SEQ ID NO: 61804 - RNA, 1698 nt, Artificial Sequence; identical to SEQ ID NO: 61750
  derived and/or modified sequence opt1 from hemagglutinin__InfluenzaA__ABD78038

SEQ ID NO: 61805 - RNA, 1701 nt, Artificial Sequence; identical to SEQ ID NO: 61785
  derived and/or modified sequence opt1 from hemagglutinin__InfluenzaA__ABD78049

SEQ ID NO: 61806 - RNA, 1698 nt, Artificial Sequence; identical to SEQ ID NO: 61304
  derived and/or modified sequence opt1 from hemagglutinin__InfluenzaA__ABD78060

SEQ ID NO: 61807 - RNA, 1698 nt, Artificial Sequence
  derived and/or modified sequence opt1 from hemagglutinin__InfluenzaA__ABD78071
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucuccggcggcuucgggagcggcaucaucacguccaacgcccccaugggggagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcggccuguucggggccaucgccggcuucaucgagggcggguggaccgggaugguggacggcugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacggcugcuucgaguucuaccacaagugcaacaacgagugcauggagagcgugaagaacgggaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacggcucccugcagugccggaucugcaucuga

SEQ ID NO: 61808 - RNA, 1698 nt, Artificial Sequence
  derived and/or modified sequence opt1 from hemagglutinin__InfluenzaA__ABD78093
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61809 - RNA, 1701 nt, Artificial Sequence
  derived and/or modified sequence opt1 from hemagglutinin__InfluenzaA__ABD78115
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccgacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccagccuguacgugcaggccuccgggcgcgucaccgugagcacgaagcggagccagcagaccgugaucccgaacaucggcucccgccccuggguccgcggggugagcucccggaucagcaucuacuggaccaucgugaagcccggcgacauccuccugaucaacuccaccgggaaccugaucgcgccccggggcuacuucaagauccgcagcggcaaguccagcaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcucaaccggcugaucgagaagaccaacgagaaguuccaccagaucgagaaggaguucagcgagguggaggggcgcauccaggaccuggagaaguacguggaggacacgaagaucgaccucugguccuacaacgccgagcugcuggucgcccucgagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcaacgaggcccugaacaaccgguuccagaucaagggcgucgagcucaagagcggcuacaaggacuggauccuguggaucuccuucgccaucagcugcuuccugcugugcguggugcuccugggguucaucaugugggccugccagaagggcaacauccgcugcaacaucugcaucuga

SEQ ID NO: 61810 - RNA, 1701 nt, Artificial Sequence
  derived and/or modified sequence opt1 from hemagglutinin__InfluenzaA__ABD78126
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccgacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccagccuguacgugcaggccuccgggcgcgucaccgugagcacgaagcggagccagcagaccgugaucccgaacaucggcucccgccccuggguccgcggggugagcuccaucaucagcaucuacuggaccaucgugaagcccggcgacauccuccugaucaacuccaccgggaaccugaucgcgccccggggcuacuucaagauccggagcggcaaguccagcaucaugcgcuccgacgccccgaucgggaacugcaacagcgagugcaucacgcccaacggcuccauccccaacgacaagcccuuccagaacgucaaccggaucaccuacggggccugcccgcgcuacgugaagcagaacacccucaagcuggccaccggcaugcggaacgugcccgagaagcagacgcgcgggaucuucggcgccaucgccggcuucaucgagaacgggugggagggcauggucgacgggugguacggcuuccggcaccagaacagcgaggggaccggccaggccgccgaccugaaguccacccaggcggccaucaaccagaucaacggcaagcucaaccgccugaucgagaagaccaacgagaaguuccaccagaucgagaaggaguucagcgagguggaggggcggauccaggaccuggagaaguacguggaggacacgaagaucgaccucugguccuacaacgccgagcugcuggucgcccucgagaaccagcacaccaucgaccugaccgacagcgagaugaacaagcuguucgagcgcacccggaagcagcuccgcgagaacgccgaggacaugggcaacgggugcuucaagaucuaccacaagugcgacaacgcgugcaucggcuccauccgcaacgggacguacgaccacgacguguaccgggacgaggcccugaacaaccgcuuccagaucaagggcgucgagcucaagagcggcuacaaggacuggauccuguggaucuccuucgccaucagcugcuuccugcugugcguggugcuccugggguucaucaugugggccugccagaagggcaacauccggugcaacaucugcaucuga

SEQ ID NO: 61811 - RNA, 1701 nt, Artificial Sequence
  derived and/or modified sequence opt1 from hemagglutinin__InfluenzaA__ABD79032
augaagaccaucaucgcccugagcuacaucuucugccucgugcugggccaggacuuccccgggaacgacaacuccaccgccacgcugugccucggccaccacgcggucccgaacgggacccuggugaagaccaucaccaacgaccagaucgaggugacgaacgccaccgagcugguccagagcuccagcaccggcaagaucugcaacaacccccaccgcauccucgacgggaucgacugcacccugaucgacgcccugcucggcgacccccacugcgacggcuuccagaacgagacgugggaccuguucguggagcgguccaaggccuucagcaacugcuaccccuacgacgugccggacuacgccucccugcgcagccucgucgcguccagcgggacccuggaguucaucuccgagggcuucaccuggaccggggugacgcagaacggcgggagcaacgccugcaagcggggccccgacaucggcuucuucucccgccugaacuggcucuacaagagcggguccaccuaccccgugcugaacgucaccaugcccaacaacgacaacuucgacaagcuguacaucuggggcgugcaccacccgagcaccgaccaggagcagacgucccucuacgugcaggccagcgggcgggucaccguguccaccaagcgcagccagcagaccaucauccccaacaucggcagccggcccugggugcgcggccuguccagccggaucuccaucuacuggacgaucgucaagcccggggacauccuggugaucaacagcaacggcaaccucaucgccccgcgcggguacuucaagaugcggaccggcaaguccagcaucaugcgcuccgacgcgcccaucgggaccugcaucagcgagugcaucacccccaacggcuccauccccaacgacaagccguuccagaacgugaacaagaucacguacggcgccugccccaaguacgucaagcagaacacccugaagcuggccaccgggaugcggaacgugcccgagaagcagacccgcggccucuucagcgccaucgccggguucaucgagaacggcugggaggggaugaucgacggcugguacggcuuccggcaccagaacuccgaggggacgggccaggcggccgaccucaagagcacccaggccgccaucgaccagaucaacgggaagcugaaccgcgugaucgagaagaccaacgagaaguuccaccagaucgagaaggaguucuccgaggucgagggccggauccaggaccucgagaaguacguggaggacaccaagaucgaccuguggagcuacaacgccgagcugcucguggcgcuggagaaccagcacacgaucgaccugaccgacuccgagaugaacaagcuguucgagaagacccgccggcagcugcgcgagaacgccgaggacauggggaacggcugcuucaagaucuaccacaagugcgacaacgccugcaucggcagcauccggaacgggaccuacgaccacgacgucuaccgcgacgaggcccugaacaaccgcuuccagaucaagggcguggagcucaaguccggguacaaggacuggauccuguggaucagcuucgccaucuccugcuuccugcucugcgucgugcugcugggcuucaucaugugggcgugccagaagggcaacauccggugcaacaucugcaucuga

SEQ ID NO: 61812 - RNA, 1701 nt, Artificial Sequence
  derived and/or modified sequence opt1 from hemagglutinin__InfluenzaA__ABD79112
augaaggccaagcugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccgccugaagggcaucgcgccccuccagcuggggaagugcaacaucgccggcuggauccuggggaacccggagugcgagagccuccuguccaagcggagcugguccuacaucgccgagacccccaacagcgagaacggcgccugcuaccccggcgacuucgccgacuacgaggagcugcgcgagcagcucuccagcguguccagcuucgagcgguucgagaucuuccccaaggggcgcuccuggccggagcacaacaucgacaucggcgugaccgccgcgugcagccacgccgggaaguccagcuucuacaagaaccugcuguggcucaccgagaaggacggcuccuaccccaaccugaacaagagcuacgucaacaagaaggagaaggaggugcugauccucuggggcgugcaccacccgcccaacaucgagaaccagaagacgcuguaccggaaggagaacgccuacgucuccguggugagcagcaacuacaaccgccgguucacccccgagaucgccgagcgccccaagguccgggggcaggccggccgcaucaacuacuacuggacccugcucgagcccggggacaccaucaucuucgaggcgaacggcaaccugaucgcccccugguacgccuucgcccugaaccgggggaucggcuccggcaucaucacgagcaacgccuccauggacgagugcgacaccaagugccagaccccgcagggggcgaucaacagcucccuccccuuccagaacauccaccccuucaccaucggcgagugccccaaguacgugcgcagcacgaagcugcggauggugaccgggcugcgcaacaucccguccauccagagccggggccucuucggggccaucgccggcuucaucgagggcgggugggacggcaugaucgacgggugguacggcuaccaccaccagaacgagcagggguccggcuacgccgccgaccagaaguccacccagaacgcgaucaacggcaucaccaacaaggucaacagcgugaucgagaagaugaacacgcaguucaccgccguggggaaggaguucaacaagcuggagaagcgcauggagaaccugaacaagaaggucgacgacggcuuccucgacaucuggaccuacaacgccgagcugcuggugcuccuggagaacgagcggacccuggacuuccacgacagcaacgugaagaaccucuacgagaaggucaagaaccagcugcgcaacaacgccaaggagaucgggaacggcugcuucgaguucuaccacaagugcaacaacgagugcauggaguccgugaagaacgggacguacgacuaccccaaguucagcgaggaguccaagcugaaccgggagaagaucgacggcgugaagcucgagagcaugggcgucuaccagauccuggccaucuacuccaccguggcgagcucccugguccuccuggugagccugggggccaucagcuucuggaugugcuccaacggcagccuccagugccgcaucugcaucuga

SEQ ID NO: 61813 - RNA, 1701 nt, Artificial Sequence
  derived and/or modified sequence opt1 from hemagglutinin__InfluenzaA__ABD79123
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcaagaacugcacccugaucgacgcccuccugggggacccccacugcgacggcuuccagaacaaggagugggaccuguucguggagcggagcacggccuacuccaacugcuaccccuacgacgugccggacuacgcgagccuccgcucccuggucgccagcuccggcacccuggaguucaccaaggagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccagcaccgacuccgaccagaccagccuguacgugcaggccuccgggcgggucacggugagcaccaagcgcagccagcagaccgugaucccgaacaucggcucccggcccuggguccgcggggugagcucccggaucagcaucuacuggaccaucgugaagcccggcgacauccuccugaucaacuccacggggaaccugaucgcgccccgcggcuacuucaagauccggagcggcaaguccagcaucaugcgcuccgacgccccgaucgacaacugcaacagcgagugcaucacccccaacggguccaucagcaacgacaagcccuuccagaacgucaaccggaucaccuacggcgccugcccccgcuacgugaagcagaacacccucaagcuggccacggggaugcggaacgugccggagaagcagacccgcggcaucuucggggccaucgccggcuucaucgagaacggcugggaggggauggucgacggcugguacggguuccggcaccagaacuccgagggcaccgggcaggccgccgaccucaagagcacccaggcggccaucaaccagaucaacggcaagcugaaccgccugaucgagaagacgaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugaccgacuccgagaugaacaagcuguucgagcgcacgcggaagcagcuccgcgagaacgccgaggacauggggaacggcugcuuccgcaucuaccacaagugcgacaacgcgugcaucgggagcauccggaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcguggugcuccugggcuucaucaugugggccugccagaaggggaacauccgcugcaacaucugcaucuga

SEQ ID NO: 61814 - RNA, 1701 nt, Artificial Sequence
  derived and/or modified sequence opt1 from hemagglutinin__InfluenzaA__ABD79134
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcaagaacugcacccugaucgacgcccuccugggggacccccacugcgacggcuuccagaacaagaagugggaccuguucguggagcggagcacggccuacuccaacugcuaccccuacgacgugccggacuacgcgagccuccgcucccuggucgccagcuccggcacccuggaguucaccaaggagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccagcaccgacuccgaccagaccagccuguacgugcaggccuccgggcgggucacggugagcaccaagcgcagccagcagaccgugaucccgaacaucggcucccggcccuggguccgcggggugagcucccggaucagcaucuacuggaccaucgugaagcccggcgacauccuccugaucaacuccacggggaaccugaucgcgccccgcggcuacuucaagauccggagcggcaaguccagcaucaugcgcuccgacgccccgaucgacaacugcaacagcgagugcaucacccccaacggguccaucagcaacgacaagcccuuccagaacgucaaccggaucaccuacggcgccugcccccgcuacgugaagcagaacacccucaagcuggccacggggaugcggaacgugccggagaagcagacccgcggcaucuucggggccaucgccggcuucaucgagaacggcugggaggggauggucgacggcugguacggguuccggcaccagaacuccgagggcaccgggcaggccgccgaccucaagagcacccaggcggccaucaaccagaucaacggcaagcugaaccgccugaucgagaagacgaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugaccgacuccgagaugaacaagcuguucgagcgcacgcggaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcguggugcuccugggcuucaucaugugggccugccagaaggggaacauccggugcaacaucugcaucuga

SEQ ID NO: 61815 - RNA, 1701 nt, Artificial Sequence
  derived and/or modified sequence opt1 from hemagglutinin__InfluenzaA__ABD79145
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcaagaacugcacccugaucgacgcccuccugggggacccccacugcgacggcuuccagaacaaggagugggaccuguucguggagcggagcacggccuacuccaacugcuaccccuacgacgugccggacuacgcgagccuccgcucccuggucgccagcuccggcacccuggaguucaccaaggagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccagcaccgacuccgaccagaccagccuguacgugcaggccuccgggcgggucacggugagcaccaagcgcagccagcagaccgugaucccgaacaucggcucccggcccuggguccgcggggugagcucccggaucagcaucuacuggaccaucgugaagcccggcgacauccuccugaucaacuccacggggaaccugaucgcgccccgcggcuacuucaagauccggagcggcaaguccagcaucaugcgcuccgacgccccgaucgacaacugcaacagcgagugcaucacccccaacggguccaucagcaacgacaagcccuuccagaacgucaaccggaucaccuacggcgccugcccccgcuacgugaagcagaacacccucaagcuggccacggggaugcggaacgugccggagaagcagacccgcggcaucuucggggccaucgccggcuucaucgagaacggcugggaggggauggucgacggcugguacggguuccggcaccagaacuccgagggcaccgggcaggccgccgaccucaagagcacccaggcggccaucaaccagaucaacggcaagcugaaccgccugaucgagaagacgaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugaccgacuccgagaugaacaagcuguucgagcgcacgcggaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcguggugcuccugggcuucaucaugugggccugccagaaggggaacauccggugcaacaucugcaucuga

SEQ ID NO: 61816 - RNA, 1701 nt, Artificial Sequence; identical to SEQ ID NO: 61815
  derived and/or modified sequence opt1 from hemagglutinin__InfluenzaA__ABD79156

SEQ ID NO: 61817 - RNA, 1701 nt, Artificial Sequence; identical to SEQ ID NO: 61031
  derived and/or modified sequence opt1 from hemagglutinin__InfluenzaA__ABD79167

SEQ ID NO: 61818 - RNA, 1701 nt, Artificial Sequence; identical to SEQ ID NO: 61815
  derived and/or modified sequence opt1 from hemagglutinin__InfluenzaA__ABD79178

SEQ ID NO: 61819 - RNA, 1701 nt, Artificial Sequence
  derived and/or modified sequence opt1 from hemagglutinin__InfluenzaA__ABD79189
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcaagaacugcacccugaucgacgcccuccugggggacccccacugcgacggcuuccagaacaaggagugggaccuguucguggagcggagcacggccuacuccaacugcuaccccuacgacgugccggacuacgcgagccuccgcucccuggucgccagcuccggcacccuggaguucaccaaggagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccagcaccgacuccgaccagaccagccuguacgugcaggccuccgggcgggucacggugagcaccaagcgcagccagcagaccgugaucccgaacaucggcucccggcccuggguccgcggggugagcucccggaucagcaucuacuggaccguggucaagcccggcgacauccuccugaucaacuccacggggaaccugaucgcgccccgcggcuacuucaagauccggagcggcaaguccagcaucaugcgcuccgacgccccgaucgacagcugcaacuccgagugcaucacccccaacgggagcaucuccaacgacaagcccuuccagaacgugaaccggaucaccuacggcgccugcccccgcuacgugaagcagaacacccucaagcuggccacggggaugcggaacgucccggagaagcagacccgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcucaaccgccugaucgagaagacgaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugaccgacagcgagaugaacaagcuguucgagcgcacgcggaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucagcuucgccaucuccugcuuccugcugugcgugguccuccugggcuucaucaugugggccugccagaaggggaacauccggugcaacaucugcaucuga

SEQ ID NO: 61820 - RNA, 1701 nt, Artificial Sequence; identical to SEQ ID NO: 61815
  derived and/or modified sequence opt1 from hemagglutinin__InfluenzaA__ABD79200

SEQ ID NO: 61821 - RNA, 1701 nt, Artificial Sequence
  derived and/or modified sequence opt1 from hemagglutinin__InfluenzaA__ABD79211
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcaagaacugcacccugaucgacgcccuccugggggacccccacugcgacggcuuccagaacaaggagugggaccuguucguggagcggagcacggccuacuccaacugcuaccccuacgacgugccggacuacgcgagccuccgcucccuggucgccagcuccggcacccuggaguucaccaaggagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccagcaccgacuccgaccagaccagccuguacgugcaggccuccgggcgggucacggugagcaccaagcgcagccagcagaccgugaucccgaacaucggcucccggcccuggauccgcggggucagcucccggaucagcaucuacuggaccaucgugaagcccggcgacauccuccugaucaacuccacggggaaccugaucgcgccccgcggcuacuucaagauccggagcggcaaguccagcaucaugcgcuccgacgccccgaucgacaacugcaacagcgagugcaucacccccaacggguccaucagcaacgacaagcccuuccagaacgugaaccggaucaccuacggcgccugcccccgcuacgucaagcagaacacccucaagcuggccacggggaugcggaacgugccggagaagcagacccgcggcaucuucggggccaucgccggcuucaucgagaacggcugggaggggaugguggacggcugguacggguuccggcaccagaacuccgagggcaccgggcaggccgccgaccucaagagcacccaggcggccaucaaccagaucaacggcaagcugaaccgccugaucgagaagacgaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugaccgacuccgagaugaacaagcuguucgagcgcacgcggaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcugaaguccggcuacaaggacuggauccucuggaucagcuucgccaucagcugcuuccugcugugcgucgugcuccugggcuucaucaugugggccugccagaaggggaacauccggugcaacaucugcaucuga

SEQ ID NO: 61822 - RNA, 1701 nt, Artificial Sequence; identical to SEQ ID NO: 61031
  derived and/or modified sequence opt1 from hemagglutinin__InfluenzaA__ABD79222

SEQ ID NO: 61823 - RNA, 1701 nt, Artificial Sequence; identical to SEQ ID NO: 61031
  derived and/or modified sequence opt1 from hemagglutinin__InfluenzaA__ABD79233

SEQ ID NO: 61824 - RNA, 1701 nt, Artificial Sequence
  derived and/or modified sequence opt1 from hemagglutinin__InfluenzaA__ABD79244
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcaagaacugcacccugaucgacgcccuccugggggacccccacugcgacggcuucaagaacaaggagugggaccuguucguggagcggagcacggccuacuccaacugcuaccccuacgacgugccggacuacgcgagccuccgcucccuggucgccagcuccggcacccuggaguucaccaacgagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccagcaccgacuccgaccagaccagccuguacgugcaggccuccgggcgggucacggugagcaccaagcgcagccagcagaccgugaucccgaacaucggcucccggcccuggguccgcggggugagcucccggaucagcaucuacuggaccaucgugaagcccggcgacauccuccugaucaacuccacggggaaccugaucgcgccccgcggcuacuucaagauccggagcggcaaguccagcaucaugcgcuccgacgccccgaucgacaacugcaacagcgagugcaucacccccaacggguccauccccaacgacaagcccuuccagaacgucaaccggaucaccuacggcgccugcccgcgcuacgugaagcagaacacccucaagcuggccacggggaugcggaacgugcccgagaagcagacccgcggcaucuucggggccaucgccggcuucaucgagaacggcugggaggggauggucgacggcugguacggguuccggcaccagaacagcgagggcaccgggcaggccgccgaccugaaguccacccaggcggccaucaaccagaucaacggcaagcucaaccgccugaucgagaagacgaacgagaaguuccaccagaucgagaaggaguucagcgagguggagggccggauccaggaccuggagaaguacguggaggacaccaagaucgaccucugguccuacaacgccgagcugcuggucgcccucgagaaccagcacaccaucgaccugaccgacagcgagaugaacaagcuguucgagcgcacgcggaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcugugcguggugcuccugggcuucaucaugugggccugccagaaggggaacauccggugcaacaucugcaucuga

SEQ ID NO: 61825 - RNA, 1701 nt, Artificial Sequence; identical to SEQ ID NO: 61251
  derived and/or modified sequence opt1 from hemagglutinin__InfluenzaA__ABD94734

SEQ ID NO: 61826 - RNA, 1701 nt, Artificial Sequence; identical to SEQ ID NO: 61638
  derived and/or modified sequence opt1 from hemagglutinin__InfluenzaA__ABD94745

SEQ ID NO: 61827 - RNA, 1701 nt, Artificial Sequence
  derived and/or modified sequence opt1 from hemagglutinin__InfluenzaA__ABD94767
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgacaacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggaccagaacgggaccuccagcgccugcaagcggcgcuccaacaagagcuucuucucccggcucaacuggcugcaccagcugaaguacaaguaccccgcccucaacgucacgaugcccaacaacgagaaguucgacaagcuguacaucuggggcgugcaccaccccagcaccgacuccgaccagaucagccuguacgcgcaggccagcgggcgcgugaccgucuccaccaagcggagccagcagaacgugaucccgaacaucggcucccgccccugggugcgcggggucagcucccggaucagcaucuacuggacgaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacgggugggagggcaugguggacggcugguacggguuccgccaccagaacagcgagggcaccgggcaggccgccgaccugaaguccacgcaggcggccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacaccaucgaccugacggacagcgagaugaacaagcuguucgagcggacccgcaagcagcuccgcgagaacgccgaggacaugggcaacggcugcuucaagaucuaccacaagugcgacaacgcgugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61828 - RNA, 1698 nt, Artificial Sequence; identical to SEQ ID NO: 61808
  derived and/or modified sequence opt1 from hemagglutinin__InfluenzaA__ABD94778

SEQ ID NO: 61829 - RNA, 1698 nt, Artificial Sequence; identical to SEQ ID NO: 61808
  derived and/or modified sequence opt1 from hemagglutinin__InfluenzaA__ABD94789

SEQ ID NO: 61830 - RNA, 1701 nt, Artificial Sequence
  derived and/or modified sequence opt1 from hemagglutinin__InfluenzaA__ABD94822
augaagaccaucaucgcccugagcuacauccucugccugguguucgcccagaagauccccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcgagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaacaacgagagcuucaacuggaccgggguggcccagaacggcaccuccuacgccugcaagcgcagcuccaucaagagcuucuucucccggcugaacuggcuccaccagcugaaguacaaguaccccgcgcugaacgugaccaugcccaacaacgacaaguucgacaagcucuacaucuggggcguccaccaccccagcacggacuccgaccagaccagccuguacgcccaggccagcgggcgcgugaccguguccaccaagcggagccagcagacggucaucccgaacaucgggucccgccccugggugcggggcgugagcucccgcaucagcaucuacuggaccaucgucaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucacguacggggccugcccgcgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggacgggccaggccgcggaccugaaguccacccaggccgccaucaaccagaucaacgggaagcugaaccggcucaucgagaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagcggacccgcaagcagcugcgcgagaacgcggaggacaugggcaacgggugcuucaagaucuaccacaagugcgacaacgccugcaucggcuccauccggaacgggaccuacgaccacgacguguaccgcgacgaggcccucaacaaccgguuccagaucaagggcgucgagcugaaguccggguacaaggacuggauccuguggaucagcuucgccaucuccugcuuccuccugugcgugguccugcucggcuucaucaugugggccugccagaagggcaacauccgcugcaacaucugcaucuga

SEQ ID NO: 61831 - RNA, 1701 nt, Artificial Sequence
  derived and/or modified sequence opt1 from hemagglutinin__InfluenzaA__ABD94833
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccgacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccagccuguacgugcaggccuccgggcgcgucaccgugagcacgaagcggagccagcagaccgugaucccgaacaucggcucccgccccuggguccgcggggugagcucccggaucagcaucuacuggaccaucgugaagcccggcgacauccuccugaucaacuccaccgggaaccugaucgcgccccggggcuacuucaagauccgcagcggcaaguccagcaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcucaaccggcugaucgagaagaccaacgagaaguuccaccagaucgagaaggaguucagcgagguggaggggcgcauccaggaccuggagaaguacguggaggacacgaagaucgaccucugguccuacaacgccgagcugcuggucgcccucgagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcucaagagcggcuacaaggacuggauccuguggaucuccuucgccaucagcugcuuccugcugugcguggugcuccugggguucaucaugugggccugccagaagggcaacauccgcugcaacaucugcaucuga

SEQ ID NO: 61832 - RNA, 1701 nt, Artificial Sequence
  derived and/or modified sequence opt1 from hemagglutinin__InfluenzaA__ABD94844
augaagaccaucaucgcccugagcuacauccucugcaugguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaacaacgagagcuucaacuggaccgggguggcccagaacggcaccuccuacgccugcaagcgccggagcgugaaguccuucuucagccgccugaacuggcuccacaagcuggaguacaaguaccccgcgcugaacgucaccaugcccaacaacgacaaguucgacaagcucuacaucuggggcgugcaccaccccuccacggacagcgaccagaccucccuguacgugcaggccagcgggcgggucaccgugagcaccaagcgcucccagcagacggugaucccgaacaucgggagccggcccuggguccgcggcguguccagcaucaucuccaucuacuggaccaucgugaagcccggcgacauccugcucaucaacagcaccgggaaccugaucgcgccccggggcuacuucaagauccgcuccgggaaguccuccaucaugcggagcgacgccccgaucggcaacugcaacuccgagugcaucacccccaacggcagcauccccaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggacgggccaggccgccgaccucaagagcacccaggcggccaucaaccagaucaacgggaagcugaaccggcugaucgagaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggacccgcaagcagcugcgcgagaacgccgaggacaugggcaacgggugcuucaagaucuaccacaagugcgacaacgcgugcaucggcagcauccggaacgggaccuacgaccacgacguguaccgcgacgaggcccucaacaaccgguuccagaucaagggcgucgagcugaaguccggguacaaggacuggauccuguggaucagcuucgccaucagcugcuuccuccugugcguggugcugcucggcuucaucaugugggccugccagaagggcaacauccgcugcaacaucugcaucuga

SEQ ID NO: 61833 - RNA, 1701 nt, Artificial Sequence
  derived and/or modified sequence opt1 from hemagglutinin__InfluenzaA__ABD94855
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccaggggagcuccaccggccgcaucugcgacagcccccaccggauccuggacgggaagaacugcacccugaucgacgcccuccugggcgacccccacugcgacggcuuccagaacaaggagugggaccuguucguggagcgcuccaaggccuacagcaacugcuaccccuacgacgugccggacuacgcgucccuccggagccuggucgccuccagcgggacgcuggaguucaacaacgaguccuucaacuggaccggcguggcccagaacgggaccagcuacgccugcaagcgcggcuccgucaagagcuucuucucccggcucaacuggcugcacaagcuggaguacaaguaccccgcgcucaacgugaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgcggggugagcucccggaucagcaucuacuggaccaucgugaagcccggcgacauccuccugaucaacuccaccgggaaccugaucgcgccccggggcuacuucaagauccgcagcggcaaguccagcaucaugcgguccgacgccccgaucgacaacugcaacagcgagugcaucacccccaacggguccauccccaacgacaagcccuuccagaacgucaaccgcaucacguacggcgccugcccgcgguacgugaagcagaacacccucaagcuggccaccgggaugcgcaacgugcccgagaagcagacccggggcaucuucggggccaucgccggcuucaucgagaacggcugggaggggauggucgacggcugguacggguuccgccaccagaacagcgagggcacggggcaggccgccgaccugaaguccacccaggcggccaucaaccagaucaacggcaagcucaaccggcugaucgagaagaccaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacacgaucgaccugaccgacagcgagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagagcggcuacaaggacuggauccuguggaucuccuucgccaucagcugcuuccugcugugcguggugcuccugggcuucaucaugugggccugccagaaggggaacauccgcugcaacaucugcaucuga

SEQ ID NO: 61834 - RNA, 1701 nt, Artificial Sequence
  derived and/or modified sequence opt1 from hemagglutinin__InfluenzaA__ABD94866
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacggcccccaccagauccucgacgggaagaacugcacccugaucgacgcccugcucggcgacccccacugcgacggcuuccagaacaaggagugggaccuguucguggagcggagcaaggccuacuccaacugcuaccccuacgacgugccggacuacgcgagccugcgcucccucgucgccagcuccgggacgcuggaguucaccaacgagagcuucaacuggaccggcguggcccagaacgggaccuccuacgccugcaagcggggcagcgugaaguccuucuucagccgccugaacuggcuccacaagcuggaguacaaguaccccgcgcugaacgucacgaugcccaacaacgacaaguucgacaagcucuacaucuggggcgugcaccaccccuccaccgacagcgaccagaccucccuguacgugcagagcagcgggcggaucaccgucuccacgaagcgcagccagcagaccgugaccccgaacaucggcucccggcccugggugcgcggggucagcucccggaucagcaucuacuggaccaucgugaagcccggcgacauccugcucaucacguccaccgggaaccugaucgcgccccgcggcuacuucaagauccggcgcggcaagagcuccaucaugcggagcgacgccccgaucgacaacugcaacuccgagugcaucacccccaacgggagcauccccaacgacaagcccuuccagaacgugaaccgcaucaccuacggcgccugcccgcgguacgucaagcagaacacgcugaagcucgccaccgggaugcgcaacgugcccgagaagcagacccggggcaucuucggggccaucgccggcuucaucgagaacggcugggaggggaugguggacggcugguacggguuccgccaccagaacuccgagggcaccgggcaggccgccgaccucaagagcacgcaggccgcgaucaaccagaucaacggcaagcugaaccggcugaucgagaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagcggacccgcaagcagcugcgcgagaacgccgaggacauggggaacggcugcuucaagaucuaccacaagugcgacaacgccugcaucgggagcauccggaacggcaccuacgaccacgacgucuaccgcgacgaggcgcucaacaaccgguuccagaucaaggggguggagcugaaguccggcuacaaggacuggauccuguggaucagcuucgccaucagcugcuuccuccugugcgucgugcugcucggcuucaucaugugggccugccagaaggggaacauccgcugcaacaucugcaucuga

SEQ ID NO: 61835 - RNA, 1701 nt, Artificial Sequence
  derived and/or modified sequence opt1 from hemagglutinin__InfluenzaA__ABD94877
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccuacgccugcaagcgccggagcgugaaguccuucuucagccgccucaacuggcugcacaagcuggaguacaaguaccccgcgcucaacgucaccaugcccaacaacgacaaguucgacaagcuguacaucuggggcgugcaccaccccuccacggacagcgaccagaccucccuguacgugcaggccagcgggcgggucaccgugagcaccaagcgcucccagcagacggugaucccgaacaucgggagccggcccuggguccgcggcguguccagccggaucuccaucuacuggaccaucgugaagcccggcgacauccuccugaucaacagcaccgggaaccugaucgcgccccgcggcuacuucaagauccgguccgggaaguccuccaucaugcgcagcgacgccccgaucgacaacugcaacuccgagugcaucacccccaacggcagcauccccaacgacaagcccuuccagaacgucaaccggaucacguacggcgccugcccgcgcuacgugaagcagaacacccucaagcuggccaccgggaugcggaacgugcccgagaagcagacccgcggcaucuucggggccaucgccggcuucaucgagaacgggugggagggcauggucgacggcugguacggguuccggcaccagaacuccgagggcacggggcaggccgccgaccucaagagcacccaggcggccaucaaccagaucaacggcaagcugaaccgccugaucgagaagaccaacgagaaguuccaccagaucgagaaggaguucuccgagguggaggggcggauccaggaccuggagaaguacguggaggacaccaagaucgaccucuggagcuacaacgccgagcugcuggucgcccucgagaaccagcacacgaucgaccugaccgacuccgagaugaacaagcuguucgagcgcacccgcaagcagcuccgggagaacgccgaggacaugggcaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcguggugcuccugggguucaucaugugggccugccagaagggcaacauccggugcaacaucugcaucuga

SEQ ID NO: 61836 - RNA, 1701 nt, Artificial Sequence
  derived and/or modified sequence opt1 from hemagglutinin__InfluenzaA__ABD94888
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuucaagaacaaggagugggaccuguucguggagcgcagcacggccuacuccaacugcuaccccuacgacgugccggacuacgcgagccuccggucccuggucgccagcuccggcacccuggaguucaccaacgagggguucaacuggaccggcguggcccaggacgggacgagcuacgccugcaagcgcggcuccgugaaguccuucuucucccggcucaacuggcugcacaagcuggaguacaaguaccccgcgcucaacgucaccaugcccaacaacgacaaguucgacaagcuguacaucuggggcgugcaccaccccagcaccgacuccgaccagaccagccuguacgugcaggccuccgggcgcgucacggugagcaccaagcggagccagcagaccgugaucccgaacaucggcucccgccccuggguccgcggggugagcucccggaucagcaucuacuggaccaucgugaagcccggcgacauccuccugaucaacuccacggggaaccugaucgcgccccggggcuacuucaagauccgcagcggcaaguccagcaucaugcgguccgacgccccgaucgacaacugcaacagcgagugcaucacccccaacggguccauccccaacgacaagcccuuccagaacgucaaccgcaucaccuacggcgccugcccgcgguacgugaagcagaacacccucaagcuggccacggggaugcgcaacgugcccgagaagcagacccggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcucaaccggcugaucgagaagacgaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacaccaucgaccugaccgacagcgagaugaacaagcuguucgagcggacgcgcaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagagcggcuacaaggacuggauccuguggaucuccuucgccaucagcugcuuccugcugugcguggugcuccugggcuucaucaugugggccugccagaaggggaacauccgcugcaacaucugcaucuga

SEQ ID NO: 61837 - RNA, 1701 nt, Artificial Sequence; identical to SEQ ID NO: 61815
  derived and/or modified sequence opt1 from hemagglutinin__InfluenzaA__ABD94899

SEQ ID NO: 61838 - RNA, 1701 nt, Artificial Sequence
  derived and/or modified sequence opt1 from hemagglutinin__InfluenzaA__ABD94910
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacgcuggaguucaacaacgaguccuucaacuggaccgggguggcccagaacggcaccagcuacgccugcaagcgccgguccgucaagagcuucuucucccgccucaacuggcugcacaagcuggaguacaaguaccccgcgcucaacgugaccaugcccaacaacgacaaguucgacaagcuguacaucuggggcgugcaccaccccagcacggacuccgaccagaccagccuguacgugcaggccuccgggcgggucaccgugagcaccaagcgcagccagcagacggugaucccgaacaucgggucccggcccuggguccgcggcgugagcucccggaucagcaucuacuggaccaucgugaagcccggcgacauccuccugaucaacuccaccgggaaccugaucgcgccccgcggcuacuucaagauccggagcgggaaguccagcaucaugcgcuccgacgccccgaucggcaacugcaacagcgagugcaucacccccaacggcuccauccccaacgacaagcccuuccagaacgucaaccggaucacguacggggccugcccgcgcuacgugaagcagaacacccucaagcuggccaccggcaugcggaacgugcccgagaagcagacccgcgggaucuucggcgccaucgccggguucaucgagaacggcugggagggcauggucgacgggugguacggcuuccggcaccagaacagcgaggggacgggccaggccgccgaccugaaguccacccaggcggccaucaaccagaucaacgggaagcucaaccgccugaucgagaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacacgaucgaccugaccgacagcgagaugaacaagcuguucgagcgcacccgcaagcagcuccgggagaacgccgaggacaugggcaacgggugcuuccgcaucuaccacaagugcgacaacgcgugcaucggcuccauccggaacgggaccuacgaccacgacguguaccgcgacgaggcccugaacaaccgguuccagaucaagggcgucgagcucaagagcggguacaaggacuggauccuguggaucuccuucgccaucagcugcuuccugcugugcguggugcuccugggcuucaucaugugggccugccagaagggcaacauccgcugcaacaucugcaucuga

SEQ ID NO: 61839 - RNA, 1701 nt, Artificial Sequence
  derived and/or modified sequence opt1 from hemagglutinin__InfluenzaA__ABD94921
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacggcccccaccagauccuggacgggaagaacugcacccugaucgacgcccuccugggcgacccccacugcgacggcuuccagaacaaggagugggaccuguucguggagcgguccaaggccuacagcaacugcuaccccuacgacgugccggacuacgcgucccuccgcagccuggucgccuccagcgggacgcuggaguucaccaacgaguccuucaacuggaccggcguggcccagaacgggaccagcuacgccugcaagcggggcuccgucaagagcuucuucucccgccucaacuggcugcacaagcuggaguacaaguaccccgcgcucaacgugacgaugcccaacaacgacaaguucgacaagcuguacaucuggggcgugcaccaccccagcaccgacuccgaccagaccagccuguacgugcaguccagcgggcgggucaccgugagcacgaagcgcucccagcagaccgugaccccgaacaucggcagccggcccuggguccgcgggguguccagccggaucuccaucuacuggaccaucgugaagcccggcgacauccuccugaucaacagcacggggaaccugaucgcgccccgcggcuacuucaagauccggcgcggcaaguccagcaucaugcgguccgacgccccgaucgacaacugcaacagcgagugcaucacccccaacggguccauccccaacgacaagcccuuccagaacgucaaccgcaucaccuacggcgccugcccgcgguacgugaagcagaacacccucaagcuggccacggggaugcgcaacgugcccgagaagcagacccggggcaucuucggggccaucgccggcuucaucgagaacggcugggaggggauggucgacggcugguacggguuccgccaccagaacagcgagggcaccgggcaggccgccgaccugaaguccacccaggccgcgaucaaccagaucaacggcaagcucaaccggcugaucgagaagacgaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacaccaucgaccugaccgacagcgagaugaacaagcuguucgagcggacgcgcaagcagcuccgcgagaacgccgaggacauggggaacggcugcuucaagaucuaccacaagugcgacaacgccugcaucggguccauccggaacggcaccuacgaccacgacguguaccgcgacgaggcgcugaacaaccgguuccagaucaagggggucgagcucaagagcggcuacaaggacuggauccuguggaucuccuucgccaucagcugcuuccugcugugcguggugcuccugggcuucaucaugugggccugccagaaggggaacauccgcugcaacaucugcaucuga

SEQ ID NO: 61840 - RNA, 1701 nt, Artificial Sequence; identical to SEQ ID NO: 61815
  derived and/or modified sequence opt1 from hemagglutinin__InfluenzaA__ABD94932

SEQ ID NO: 61841 - RNA, 1698 nt, Artificial Sequence
  derived and/or modified sequence opt1 from hemagglutinin__InfluenzaA__ABD94943
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaagaagaaggaggugcucauccuguggggcgugcaccacccgcccaacaucggggaccagcggacccuguaccacacggagaacgccuacgucagcguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagagcaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcaucugcaucuga

SEQ ID NO: 61842 - RNA, 1701 nt, Artificial Sequence; identical to SEQ ID NO: 61641
  derived and/or modified sequence opt1 from hemagglutinin__InfluenzaA__ABD94954

SEQ ID NO: 61843 - RNA, 1698 nt, Artificial Sequence; identical to SEQ ID NO: 61750
  derived and/or modified sequence opt1 from hemagglutinin__InfluenzaA__ABD94965

SEQ ID NO: 61844 - RNA, 1698 nt, Artificial Sequence; identical to SEQ ID NO: 61749
  derived and/or modified sequence opt1 from hemagglutinin__InfluenzaA__ABD94987

SEQ ID NO: 61845 - RNA, 1698 nt, Artificial Sequence; identical to SEQ ID NO: 61749
  derived and/or modified sequence opt1 from hemagglutinin__InfluenzaA__ABD94998

SEQ ID NO: 61846 - RNA, 1698 nt, Artificial Sequence; identical to SEQ ID NO: 61749
  derived and/or modified sequence opt1 from hemagglutinin__InfluenzaA__ABD95009

SEQ ID NO: 61847 - RNA, 1698 nt, Artificial Sequence; identical to SEQ ID NO: 61750
  derived and/or modified sequence opt1 from hemagglutinin__InfluenzaA__ABD95020

SEQ ID NO: 61848 - RNA, 1698 nt, Artificial Sequence
  derived and/or modified sequence opt1 from hemagglutinin__InfluenzaA__ABD95031
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucaccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucacggggaagaacggccuguaccccaaccugcggcgcagcuacgccaacaacaaggagaaggaggugcucguccuguggggcgugcaccacccgcccaacaucggggaccagaaggcccuguaccacaccgagaacgccuacguguccgucgugagcagccacuacucccggcgcuucacccccgagaucgccaagcggcccaaggugcgcggccaggaggggcggaucaacuacuacuggacccuccuggagcccggcgacacgaucaucuucgaggccaacgggaaccugaucgcgccgcgcuacgccuucgcccucagccggggcuucggcuccgggaucaucaccagcaacgcccccauggacgagugcgacgccaagugccagacgccccagggcgcgaucaacuccagccugcccuuccagaacguccacccggugaccaucggggagugccccaaguacgugcgcuccgccaagcugcggauggucaccggccuccgcaacauccccagcauccagucccgggggcuguucggcgccaucgccggcuucaucgagggcggguggaccgggaugguggacggcugguacggguaccaccaccagaacgagcagggcagcggcuacgccgcggaccagaaguccacccagaacgccaucaacgggaucaccaacaaggugaacagcaucaucgagaagaugaacacgcaguucaccgccgucggcaaggaguucaacaagcuggagcgccggauggagaaccucaacaagaagguggacgacggguuccuggacaucuggaccuacaacgccgagcugcucguccugcuggagaacgagcgcacccucgacuuccacgacuccaacgugaagaaccuguacgagaaggucaagagccagcugaagaacaacgccaaggagaucggcaacgggugcuucgaguucuaccacaagugcaacaacgagugcauggaguccgugaagaacggcacguacgacuaccccaaguacagcgaggaguccaagcucaaccgggagaagaucgacggcgugaagcuggagagcauggggguguaccagauccuggcgaucuacuccaccgucgccagcagccucgugcugcuggugucccucggcgccaucagcuucuggaugugcuccaacgggagccugcagugccgcaucugcaucuga

SEQ ID NO: 61849 - RNA, 1698 nt, Artificial Sequence
  derived and/or modified sequence opt1 from hemagglutinin__InfluenzaA__ABD95042
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaagggcaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggcuucgggagcggcaucaucacguccaacgcccccaugggggagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccggggccuguucggggccaucgccggcuucaucgagggcggguggaccgggaugguggacggcugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacggcucccugcagugccgcaucugcaucuga

SEQ ID NO: 61850 - RNA, 1698 nt, Artificial Sequence; identical to SEQ ID NO: 61849
  derived and/or modified sequence opt1 from hemagglutinin__InfluenzaA__ABD95053

SEQ ID NO: 61851 - RNA, 1698 nt, Artificial Sequence; identical to SEQ ID NO: 61808
  derived and/or modified sequence opt1 from hemagglutinin__InfluenzaA__ABD95064

SEQ ID NO: 61852 - RNA, 1698 nt, Artificial Sequence
  derived and/or modified sequence opt1 from hemagglutinin__InfluenzaA__ABD95075
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucuccaagggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgcgagaagaucgacggggugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 61853 - RNA, 1698 nt, Artificial Sequence; identical to SEQ ID NO: 61849
  derived and/or modified sequence opt1 from hemagglutinin__InfluenzaA__ABD95086

SEQ ID NO: 61854 - RNA, 1698 nt, Artificial Sequence; identical to SEQ ID NO: 61808
  derived and/or modified sequence opt1 from hemagglutinin__InfluenzaA__ABD95097

SEQ ID NO: 61855 - RNA, 1698 nt, Artificial Sequence
  derived and/or modified sequence opt1 from hemagglutinin__InfluenzaA__ABD95119
augaaggccaagcugcucauccugcugugcaccuucaccgccacguacgcggacaccaucugcaucggcuaccacgccaacaacagcaccgacaccguggacacgguccucgagaagaacgugaccgugacccacuccgucaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcgucuccagcuucgagcgguucgagaucuucccgaagggguccagcuggcccaaccacaccgugaccggcguguccgccagcugcucccacaacggcaagagcuccuucuaccgcaaccugcuguggcucaccgggaagaacgggcuguaccccaaccugagcauguccuacgucaacaacaaggagaaggaggugcucgugcuguggggcguccaccacccgcccaacaucggcgaccagcgggcccuguaccacacggagaacgccuacgugagcguggucagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacgugcacccggucaccaucggcgagugccccaaguacgugcgcagcgccaagcugcggauggugaccgggcuccgcaacauccccuccauccagagccggggccuguucggcgccaucgccggguucaucgagggcggguggaccggcauggucgacgggugguacggcuaccaccaccagaacgagcagggcuccggguacgcggccgaccagaaguccacccagaacgccaucaacggcaucaccaacaaggugaacagcgugaucgagaagaugaacacccaguucacggccgucgggaaggaguucaacaagcuggagcgccggauggagaaccucaacaagaagguggacgacggcuuccuggacaucuggaccuacaacgccgagcugcucguccugcuggagaacgagcgcacccucgacuuccacgacagcaacgugaagaaccuguacgagaaggugaagucccagcugaagaacaacgcgaaggagaucgggaacggcugcuucgaguucuaccacaagugcaacaacgagugcauggagagcgucaagaacggcaccuacgacuaccccaaguacuccgaggagagcaagcucaaccgggagaagaucgacggggugaagcuggaguccaugggcguguaccagauccuggccaucuacagcacggucgccagcucccucgugcugcuggugagccucggggccaucuccuucuggaugugcagcaacggcucccugcagugccgcaucugcaucuga

SEQ ID NO: 61856 - RNA, 1698 nt, Artificial Sequence
  derived and/or modified sequence opt1 from hemagglutinin__InfluenzaA__ABD95130
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggagcuaccccaaccuguccaugagcuacgugaacaacaaggagaaggaggugcugguccucuggggcgugcaccacccgcccaacaucggcgaccagcgggcccuguaccacacggagaacgccuacgugagcgucguguccagccacuacucccgccgguucacccccgagaucgccaagcgccccaaggugcgggaccaggaggggcgcaucaacuacuacuggacccugcucgagcccggcgacaccaucaucuucgaggcgaacgggaaccugaucgccccgugguacgccuucgcccugagccggggcuucggcuccgggaucaucacgagcaacgcccccaugggcgagugcgacgcgaagugccagacgccccagggggccaucaacuccagccuccccuuccagaacguccacccggugaccaucggcgagugccccaaguacgugcgcuccgccaagcugcggauggucaccgggcugcgcaacauccccagcauccagucccggggccucuucggcgccaucgccggguucaucgagggcggguggaccggcaugguggacgggugguacggcuaccaccaccagaacgagcagggcagcggguacgcggccgaccagaaguccacccagaacgccaucaacggcaucaccaacaaggugaacagcgucaucgagaagaugaacacccaguucacggccguggggaaggaguucaacaagcuggagcgccggauggagaaccugaacaagaaggucgacgacggcuuccucgacaucuggaccuacaacgccgagcugcuggugcuccuggagaacgagcgcacccuggacuuccacgacuccaacgugaagaaccucuacgagaaggucaagagccagcugaagaacaacgcgaaggagaucgggaacggcugcuucgaguucuaccacaagugcaacaacgagugcauggaguccgugaagaacggcaccuacgacuaccccaaguacagcgaggaguccaagcugaaccgggagaagaucgacggggugaagcucgagagcaugggcgucuaccagauccuggccaucuacagcacgguggccuccagccuggugcuccuggucucccugggggccaucagcuucuggaugugcuccaacggcagccuccagugccgcaucugcaucuga

SEQ ID NO: 61857 - RNA, 1698 nt, Artificial Sequence; identical to SEQ ID NO: 61808
  derived and/or modified sequence opt1 from hemagglutinin__InfluenzaA__ABD95141

SEQ ID NO: 61858 - RNA, 1698 nt, Artificial Sequence; identical to SEQ ID NO: 61808
  derived and/or modified sequence opt1 from hemagglutinin__InfluenzaA__ABD95152

SEQ ID NO: 61859 - RNA, 1698 nt, Artificial Sequence; identical to SEQ ID NO: 61855
  derived and/or modified sequence opt1 from hemagglutinin__InfluenzaA__ABD95163

SEQ ID NO: 61860 - RNA, 1698 nt, Artificial Sequence; identical to SEQ ID NO: 61849
  derived and/or modified sequence opt1 from hemagglutinin__InfluenzaA__ABD95174

SEQ ID NO: 61861 - RNA, 1698 nt, Artificial Sequence
  derived and/or modified sequence opt1 from hemagglutinin__InfluenzaA__ABD95185
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggggagagcuccuucuaccgcaaccugcuguggcucaccggcaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61862 - RNA, 1698 nt, Artificial Sequence; identical to SEQ ID NO: 61849
  derived and/or modified sequence opt1 from hemagglutinin__InfluenzaA__ABD95196

SEQ ID NO: 61863 - RNA, 1698 nt, Artificial Sequence; identical to SEQ ID NO: 61307
  derived and/or modified sequence opt1 from hemagglutinin__InfluenzaA__ABD95207

SEQ ID NO: 61864 - RNA, 1698 nt, Artificial Sequence; identical to SEQ ID NO: 61808
  derived and/or modified sequence opt1 from hemagglutinin__InfluenzaA__ABD95218

SEQ ID NO: 61865 - RNA, 1698 nt, Artificial Sequence; identical to SEQ ID NO: 61855
  derived and/or modified sequence opt1 from hemagglutinin__InfluenzaA__ABD95229

SEQ ID NO: 61866 - RNA, 1698 nt, Artificial Sequence; identical to SEQ ID NO: 61808
  derived and/or modified sequence opt1 from hemagglutinin__InfluenzaA__ABD95240

SEQ ID NO: 61867 - RNA, 1698 nt, Artificial Sequence; identical to SEQ ID NO: 61849
  derived and/or modified sequence opt1 from hemagglutinin__InfluenzaA__ABD95251

SEQ ID NO: 61868 - RNA, 1698 nt, Artificial Sequence; identical to SEQ ID NO: 61307
  derived and/or modified sequence opt1 from hemagglutinin__InfluenzaA__ABD95262

SEQ ID NO: 61869 - RNA, 1698 nt, Artificial Sequence; identical to SEQ ID NO: 61808
  derived and/or modified sequence opt1 from hemagglutinin__InfluenzaA__ABD95273

SEQ ID NO: 61870 - RNA, 1698 nt, Artificial Sequence; identical to SEQ ID NO: 61304
  derived and/or modified sequence opt1 from hemagglutinin__InfluenzaA__ABD95284

SEQ ID NO: 61871 - RNA, 1698 nt, Artificial Sequence; identical to SEQ ID NO: 61808
  derived and/or modified sequence opt1 from hemagglutinin__InfluenzaA__ABD95295

SEQ ID NO: 61872 - RNA, 1698 nt, Artificial Sequence
  derived and/or modified sequence opt1 from hemagglutinin__InfluenzaA__ABD95306
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggagauccucgugcuguggggcguccaccacccgcccaacaucggcgaccagcgggcccuguaccacacggagaacgccuacgugagcguggucagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacgugcacccggucaccaucggcgagugccccaaguacgugcgcagcgccaagcugcggauggugaccgggcuccgcaacauccccuccauccagagccggggccuguucggcgccaucgccggguucaucgagggcggguggaccggcauggucgacgggugguacggcuaccaccaccagaacgagcagggcuccggguacgcggccgaccagaaguccacccagaacgccaucaacggcaucaccaacaaggugaacagcgugaucgagaagaugaacacccaguucacggccgucgggaaggaguucaacaagcuggagcgccggauggagaaccucaacaagaagguggacgacggcuuccuggacaucuggaccuacaacgccgagcugcucguccugcuggagaacgagcgcacccucgacuuccacgacagcaacgugaagaaccuguacgagaaggugaagucccagcugaagaacaacgcgaaggagaucgggaacggcugcuucgaguucuaccacaagugcaacaacgagugcauggagagcgucaagaacggcaccuacgacuaccccaaguacuccgaggagagcaagcucaaccgggagaagaucgacggggugaagcuggaguccaugggcguguaccagauccuggccaucuacagcacggucgccagcucccucgugcugcuggugagccucggggccaucuccuucuggaugugcagcaacggcucccugcagugccgcaucugcaucuga

SEQ ID NO: 61873 - RNA, 1698 nt, Artificial Sequence; identical to SEQ ID NO: 61849
  derived and/or modified sequence opt1 from hemagglutinin__InfluenzaA__ABD95328

SEQ ID NO: 61874 - RNA, 1701 nt, Artificial Sequence
  derived and/or modified sequence opt1 from hemagglutinin__InfluenzaA__ABD95339
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagagcuccuggccgaagcacagcgucacccgcggggugacggccuccugcagccacaagggcaaguccagcuucuaccggaaccuccuguggcugaccgagaagaacgggagcuaccccaaccucuccaagagcuacgugaacgacaaggagaaggagguccuggugcuguggggcgugcaccaccccuccaacaucgaggaccagaagaccaucuaccggaaggagaacgccuacgucagcgugguguccagccacuacaaccgccgguucacccccgagaucgcgaagcgcccgaagguccgggaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgugagcauggacgagugcgacgcgaagugccagacgccccagggcgccaucaacuccagccugccguuccagaacgugcaccccgucaccaucggcgagugccccaaguacgugcgcuccaccaagcugcggauggugaccgggcuccgcaacauccccagcauccagucccggggccuguucggggccaucgccggcuucaucgagggcggcuggaccggcaugaucgacgggugguacggcuaccaccaccagaacgagcaggggagcggcuacgccgcggaccagaaguccacgcagaacgccaucaacgggaucaccaacaaggucaacagcgugaucgagaagaugaacacccaguucaccgccgugggcaaggaguucaacaagcuggagaagcgcauggagaaccucaacaagaaggucgacgacggcuuccuggacaucuggacguacaacgccgagcugcucgugcugcuggagaacgagcggacccucgacuuccacgacuccaacgucaagaaccuguacgagaaggucaagagccagcugaagaacaacgccaaggagaucgggaacggcugcuucgaguucuaccacaagugcaacaacgagugcauggagagcgugaagaacgggaccuacgacuacccgaaguacuccgaggagagcaagcucaaccgcgagaagaucgacggcgugaagcuggaguccauggggguguaccagauccuggcgaucuacagcaccguggccuccagccucguccugcuggugucccucggcgccaucagcuucuggaugugcuccaacggcagccugcagugccggaucugcaucuga

SEQ ID NO: 61875 - RNA, 1698 nt, Artificial Sequence; identical to SEQ ID NO: 61750
  derived and/or modified sequence opt1 from hemagglutinin__InfluenzaA__ABE11657

SEQ ID NO: 61876 - RNA, 1698 nt, Artificial Sequence
  derived and/or modified sequence opt1 from hemagglutinin__InfluenzaA__ABE11668
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcauguccuacgugaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61877 - RNA, 1698 nt, Artificial Sequence
  derived and/or modified sequence opt1 from hemagglutinin__InfluenzaA__ABE11679
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggcggaacggccuguaccccaaccugagcaaguccuacgccaacaacaaggagaaggaggugcucguccuguggggcgugcaccacccgcccaacaucggggaccagcgcgcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61878 - RNA, 1698 nt, Artificial Sequence
  derived and/or modified sequence opt1 from hemagglutinin__InfluenzaA__ABE11690
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61879 - RNA, 1698 nt, Artificial Sequence
  derived and/or modified sequence opt1 from hemagglutinin__InfluenzaA__ABE11701
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagaaggcccuguaccacacggagaacgccuacgugagcgucgugagcucccacuacagccggcgcuucacccccgagaucgccaagcggcccaaggugcgcgaccaggaggggcggaucaacuacuacuggacccuccuggagcccggcgacaccaucaucuucgaggcgaacgggaaccugaucgccccgugguacgccuucgcccucucccgcggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcaucaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacaacgagugcauggagagcgucaagaacggcaccuacgacuaccccaaguacuccgaggagagcaagcucaaccgcgagaagaucgacggggugaagcuggaguccaugggcguguaccagauccuggccaucuacagcacggucgccagcucccucgugcugcuggugagccucggggccaucuccuucuggaugugcagcaacggcucccugcagugccggaucugcaucuga

SEQ ID NO: 61880 - RNA, 1698 nt, Artificial Sequence; identical to SEQ ID NO: 61808
  derived and/or modified sequence opt1 from hemagglutinin__InfluenzaA__ABE11712

SEQ ID NO: 61881 - RNA, 1698 nt, Artificial Sequence; identical to SEQ ID NO: 61849
  derived and/or modified sequence opt1 from hemagglutinin__InfluenzaA__ABE11723

SEQ ID NO: 61882 - RNA, 1698 nt, Artificial Sequence; identical to SEQ ID NO: 61855
  derived and/or modified sequence opt1 from hemagglutinin__InfluenzaA__ABE11734

SEQ ID NO: 61883 - RNA, 1698 nt, Artificial Sequence; identical to SEQ ID NO: 61808
  derived and/or modified sequence opt1 from hemagglutinin__InfluenzaA__ABE11812

SEQ ID NO: 61884 - RNA, 1698 nt, Artificial Sequence; identical to SEQ ID NO: 61849
  derived and/or modified sequence opt1 from hemagglutinin__InfluenzaA__ABE11823

SEQ ID NO: 61885 - RNA, 1698 nt, Artificial Sequence; identical to SEQ ID NO: 61849
  derived and/or modified sequence opt1 from hemagglutinin__InfluenzaA__ABE11834

SEQ ID NO: 61886 - RNA, 1698 nt, Artificial Sequence; identical to SEQ ID NO: 61849
  derived and/or modified sequence opt1 from hemagglutinin__InfluenzaA__ABE11845

SEQ ID NO: 61887 - RNA, 1698 nt, Artificial Sequence; identical to SEQ ID NO: 61855
  derived and/or modified sequence opt1 from hemagglutinin__InfluenzaA__ABE11856

SEQ ID NO: 61888 - RNA, 1701 nt, Artificial Sequence
  derived and/or modified sequence opt1 from hemagglutinin__InfluenzaA__ABE11900
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucagccggggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcgcagcacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgaccagaaguccacccagaacgccaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacagcaacgucaagaaccuguacgagaaggugaagacccagcugaagaacaacgccaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacagcaccguggccuccagccucguccugcugaucucccucggggccaucagcuucuggaugugcuccaacggcagccugcagugccgcaucugcaucuga

SEQ ID NO: 61889 - RNA, 1701 nt, Artificial Sequence
  derived and/or modified sequence opt1 from hemagglutinin__InfluenzaA__ABE11942
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccagccucuccaagagcuacgucaacaacaaggagaaggaggugcuggugcuguggggcguccaccaccccagcaacaucggggaccagcgggccaucuaccacaccgagaacgcguacguguccguggucagcucccacuacagccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucucccggggcuucgggagcggcaucaucaccuccaacgccagcaugggcgagugcgacgccaagugccagaccccgcagggggccaucaacuccagccugcccuuccagaacgugcaccccgucaccaucggcgagugccccaaguacgugcgcuccacgaagcugcggauggugaccgggcuccgcaacaucccgagcauccagucccggggccuguucggggccaucgcgggcuucaucgagggcggguggaccggcaugaucgacgggugguacggcuaccaccaccagaacgagcaggggagcggcuacgccgccgaccagaaguccacccagaacgccaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacuccaacgucaagaaccuguacgagaaggugaagacccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgucaagcuggagagcaugggcguguaccagauccuggccaucuacuccaccguggccagcucccucguccugcuggugagccucggggccaucuccuucuggaugugcagcaacggcucccugcagugccgcaucugcaucuga

SEQ ID NO: 61890 - RNA, 1701 nt, Artificial Sequence
  derived and/or modified sequence opt1 from hemagglutinin__InfluenzaA__ABE12078
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccuccugaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccggaacggcaccuacgaccacgacguguaccgcgacgaggcccugaacaaccgcuuccagaucaagggggucgagcugaaguccggcuacaaggacuggauccucuggaucagcuucgccaucagcugcuuccugcugugcgugguccuccugggcuucaucaugugggccugccagaaggggaacauccggugcuccaucugcaucuga

SEQ ID NO: 61891 - RNA, 1701 nt, Artificial Sequence; identical to SEQ ID NO: 61785
  derived and/or modified sequence opt1 from hemagglutinin__InfluenzaA__ABE12123

SEQ ID NO: 61892 - RNA, 1698 nt, Artificial Sequence; identical to SEQ ID NO: 61808
  derived and/or modified sequence opt1 from hemagglutinin__InfluenzaA__ABE12248

SEQ ID NO: 61893 - RNA, 1701 nt, Artificial Sequence
  derived and/or modified sequence opt1 from hemagglutinin__InfluenzaA__ABE12623
augaagaccaucaucgcccugagcuacaucuucugccucgugcugggccaggaccugcccgggaacgacaacuccaccgccacgcucugccugggccaccacgcggucccgaacgggacccuggugaagaccaucaccaacgaccagaucgaggugacgaacgccaccgagcucguccagagcuccagcaccggcaagaucugcaacaacccccaccgcauccuggacgggaucgacugcacccugaucgacgcccuccugggcgacccccacugcgacggcuuccagaacgagacgugggaccuguucguggagcgguccaaggccuucagcaacugcuaccccuacgacgugccggacuacgccucccuccgcagccuggucgcguccagcgggacccuggaguucaucaacgagggcuucaccuggaccggggugacgcagaacggcggguccaacgccugcaagcggggccccgacagcggcuucuucucccgccucaacuggcuguacaagagcggguccaccuaccccgugcugaacgucaccaugcccaacaacgacaacuucgacaagcucuacaucuggggcgugcaccacccgagcaccaaccaggagcagacgucccuguacgugcaggccagcgggcgggucaccguguccaccaagcgcagccagcagaccaucauccccaacaucggcagccggcccugggugcgcggccuguccagccggaucuccaucuacuggacgaucgucaagcccggggacauccucgugaucaacagcaacggcaaccugaucgccccgcgcggguacuucaagaugcggaccggcaaguccagcaucaugcgcuccgacgcgcccaucgggaccugcaucagcgagugcaucacccccaacggcuccauccccaacgacaagccguuccagaacgugaacaagaucacguacggcgccugccccaaguacgucaagcagaacacccugaagcucgccaccgggaugcggaacgugcccgagaagcagacccgcggccuguucggggccaucgccggcuucaucgagaacgggugggagggcaugaucgacggcugguacggguuccggcaccagaacagcgagggcacggggcaggcggccgaccugaaguccacccaggccgccaucgaccagaucaacggcaagcucaaccgcgugaucgagaagaccaacgagaaguuccaccagaucgagaaggaguucagcgaggucgaggggcggauccaggaccuggagaaguacguggaggacaccaagaucgaccugugguccuacaacgccgagcuccugguggcgcuggagaaccagcacacgaucgaccucaccgacagcgagaugaacaagcuguucgagaagacccgccggcagcugcgcgagaacgccgaggacaugggcaacggcugcuuccggaucuaccacaagugcgacaacgccugcaucggguccauccgcaacggcaccuacgaccacgacgucuaccgcgacgaggcccucaacaaccgguuccagaucaaggggguggagcucaagagcggcuacaaggacuggauccuguggaucuccuucgccaucagcugcuuccugcugugcgucgugcugcucggcuucaucaugugggcgugccagaaggggaacauccgcugcaacaucugcaucuga

SEQ ID NO: 61894 - RNA, 1701 nt, Artificial Sequence; identical to SEQ ID NO: 61838
  derived and/or modified sequence opt1 from hemagglutinin__InfluenzaA__ABE12645

SEQ ID NO: 61895 - RNA, 1701 nt, Artificial Sequence; identical to SEQ ID NO: 61815
  derived and/or modified sequence opt1 from hemagglutinin__InfluenzaA__ABE13076

SEQ ID NO: 61896 - RNA, 1701 nt, Artificial Sequence; identical to SEQ ID NO: 61791
  derived and/or modified sequence opt1 from hemagglutinin__InfluenzaA__ABE13323

SEQ ID NO: 61897 - RNA, 1701 nt, Artificial Sequence
  derived and/or modified sequence opt1 from hemagglutinin__InfluenzaA__ABE13471
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacgcuggaguucuacaacgaguccuucaacuggaccgggguggcccagaacggcaccagcuacgccugcaagcgccgguccgucaagagcuucuucucccgccucaacuggcugcacaagcuggaguacaaguaccccgcgcucaacgugaccaugcccaacaacgacaaguucgacaagcuguacaucuggggcgugcaccaccccagcacggacuccgaccagaccagccuguacgugcaggccuccgggcgggucaccgugagcaccaagcgcagccagcagacggugaucccgaacaucgggucccggcccuggguccgcggcgugagcucccggaucagcaucuacuggaccaucgugaagcccggcgacauccuccugaucaacuccaccgggaaccugaucgcgccccgcggcuacuucaagauccggagcgggaaguccagcaucaugcgcuccgacgccccgaucggcaacugcaacagcgagugcaucacccccaacggcuccauccccaacgacaagcccuuccagaacgucaaccggaucacguacggggccugcccgcgcuacgugaagcagaacacccucaagcuggccaccggcaugcggaacgugcccgagaagcagacccgcgggaucuucggcgccaucgccggguucaucgagaacggcugggagggcauggucgacgggugguacggcuuccggcaccagaacagcgaggggacgggccaggccgccgaccugaaguccacccaggcggccaucaaccagaucaacgggaagcucaaccgccugaucgagaagaccaacgagaaguuccaccagaucgagaaggaguucagcgagguggagggccggauccaggaccuggagaaguacguggaggacaccaagaucgaccucugguccuacaacgccgagcugcuggucgcccucgagaaccagcacacgaucgaccugaccgacagcgagaugaacaagcuguucgagcgcacccgcaagcagcuccgggagaacgccgaggacaugggcaacgggugcuuccgcaucuaccacaagugcgacaacgcgugcaucggcuccauccggaacgggaccuacgaccacgacguguaccgcgacgaggcccugaacaaccgguuccagaucaagggcgucgagcucaagagcggguacaaggacuggauccuguggaucuccuucgccaucagcugcuuccugcugugcguggugcuccugggcuucaucaugugggccugccagaagggcaacauccgcugcaacaucugcaucuga

SEQ ID NO: 61898 - RNA, 1701 nt, Artificial Sequence
  derived and/or modified sequence opt1 from hemagglutinin__InfluenzaA__ABE13555
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccaggggagcuccaccggccgcaucugcgacagcccccaccggauccuggacgggaagaacugcacccugaucgacgcccuccugggcgacccccacugcgacggcuuccagaacaaggagugggaccuguucguggagcgcuccaaggccuacagcaacugcuaccccuacgacgugccggacuacgcgucccuccggagccuggucgccuccagcgggacgcuggaguucaacaacgaguccuucaacuggaccggcguggcccagaacgggaccagcuacgccugcaagcgccgguccgucaagagcuucuucucccgccucaacuggcugcacaagcuggaguacaaguaccccgcgcucaacgugaccaugcccaacaacgacaaguucgacaagcuguacaucuggggcgugcaccaccccagcacggacuccgaccagaccagccuguacgugcaggccuccgggcgggucaccgugagcaccaagcgcagccagcagacggugaucccgaacaucggcucccggcccuggguccgcggcgugagcucccggaucagcaucuacuggaccaucgugaagcccggggacauccuccugaucuccagcaccggcaaccugaucgcgccccgcggguacuucaagauccgguccggcaagagcuccaucaugcgcagcgacgccccgaucgacaacugcaacuccgagugcaucacccccaacggcagcauccccaacgacaagcccuuccagaacgucaaccggaucacguacggggccugcccgcgcuacgugaagcagaacacccucaagcuggccaccggcaugcggaacgugcccgagaagcagaccaaggggaucuucggcgccaucgccggguucaucgagaacggcugggagggcauggucgacgggugguacggcuuccgccaccagaacuccgaggggacgggccaggccgccgaccucaagagcacccaggcggccaucaaccagaucaacgggaagcugaaccggcugaucgagaagaccaacgagaaguuccaccagaucgagaaggaguucuccgagguggagggccgcauccaggaccuggagaaguacguggaggacaccaagaucgaccucuggagcuacaacgccgagcugcuggucgcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcgucgagcugaaguccggguacaaggacuggauccucuggaucagcuucgccaugagcugcuuccugcugugcguggugcuccugggcuucaucaugugggccugccagaagggcaacauccgcugcaacaucugcaucuga

SEQ ID NO: 61899 - RNA, 1701 nt, Artificial Sequence
  derived and/or modified sequence opt1 from hemagglutinin__InfluenzaA__ABE13606
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagaugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaccaacgagggguucaacuggaccggcguggcccaggacgggaccagcuacgccugcaagcgcggcuccgugaaguccuucuucucccggcugaacuggcuccacaagcuggaguacaaguaccccgcgcugaacgucacgaugcccaacaacgacaaguucgacaagcucuacaucuggggcgugcaccaccccagcaccgacuccgaccagaccagccuguacgugcaggccuccgggcgcgucaccgugagcacgaagcggagccagcagaccgugaucccgaacaucggcucccgccccuggguccgcggggugagcucccggaucagcaucuacuggaccaucgugaagcccggcgacauccugcucaucaacuccaccgggaaccugaucgcgccccggggcuacuucaagauccgcagcggcaaguccagcaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcugaaccggcucaucgagaagaccaacgagaaguuccaccagaucgagaaggaguucagcgagguggaggggcgcauccaggaccuggagaaguacguggaggacacgaagaucgaccugugguccuacaacgccgagcuccugaucgcccuggagaaccagcacaccaucgaccucaccgacagcgagaugaacaagcuguucgagcggacccgcaagcagcugcgcgagaacgccgaggacaugggcaacgggugcuucaagaucuaccacaagugcgacaacgcgugcaucggcuccauccggaacgggacguacgaccacgacgucuaccgcgacgaggcccucaacaaccgguuccagaucaagggcguggagcucaagagcggcuacaaggacuggauccuguggaucuccuucgccaucagcugcuuccugcugugcgucgugcugcucggguucaucaugugggccugccagaagggcaacauccgcugcaacaucugcaucuga

SEQ ID NO: 61900 - RNA, 1701 nt, Artificial Sequence
  derived and/or modified sequence opt1 from hemagglutinin__InfluenzaA__ABE13628
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcaacggcaagagcuccaucaugcggagcgacgccccgaucgacaacugcaacuccgagugcaucacccccaacgggagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagagcacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcaacaucugcaucuga

SEQ ID NO: 61901 - RNA, 1701 nt, Artificial Sequence
  derived and/or modified sequence opt1 from hemagglutinin__InfluenzaA__ABE13824
augaagaccaucaucgcccugagcuacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaccaacgagggguucaacuggaccggcguggcccaggacgggaaguccuacgccugcaagcgcggcuccgugaacagcuucuucucccggcugaacuggcuccacaagcuggaguacaaguaccccgcgcugaacgucaccaugcccaacaacgacaaguucgacaagcucuacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccugcucaucaacuccaccgggaaccugaucgcgccccggggcuacuucaagauccgcaacggcaagagcuccaucaugcggagcgacgccccgaucgacaacugcaacuccgagugcaucacccccaacgggagcauccccaacgacaagcccuuccagaacgugaaccgcaucacguacggcgccugcccgcgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagagcacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggacccgcaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgucgugcugcucggcuucaucaugugggccugccagaaggggaacauccgcugcaacaucugcaucuga

SEQ ID NO: 61902 - RNA, 1701 nt, Artificial Sequence; identical to SEQ ID NO: 61901
  derived and/or modified sequence opt1 from hemagglutinin__InfluenzaA__ABE14019

SEQ ID NO: 61903 - RNA, 1701 nt, Artificial Sequence
  derived and/or modified sequence opt1 from hemagglutinin__InfluenzaA__ABE14030
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaucgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacccuggaguucacgaacgagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccagcaccgacuccgaccagacgagccuguacgugcaggccuccgggcgcgucaccgugagcaccaagcggagccagcagaccgugaucccgaacaucggcucccgccccuggguccgggggaucagcucccgcaucagcaucuacuggacgaucgugaagcccggcgacauccuccugaucaacuccaccgggaaccugaucgcgccccggggcuacuucaagauccgcaacggcaagagcuccaucaugcggagcgacgccccgaucgacaacugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugguggacggcugguacggguuccgccaccagaacuccgagggcaccgggcaggccgccgaccucaagagcacgcaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacaccaucgaccugacggacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcaacaucugcaucuga

SEQ ID NO: 61904 - RNA, 1701 nt, Artificial Sequence; identical to SEQ ID NO: 61900
  derived and/or modified sequence opt1 from hemagglutinin__InfluenzaA__ABE14041

SEQ ID NO: 61905 - RNA, 1701 nt, Artificial Sequence; identical to SEQ ID NO: 61901
  derived and/or modified sequence opt1 from hemagglutinin__InfluenzaA__ABE14063

SEQ ID NO: 61906 - RNA, 1701 nt, Artificial Sequence
  derived and/or modified sequence opt1 from hemagglutinin__InfluenzaA__ABE14124
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgaccagaccagccuguacgugcaggccuccgggcgcgucaccgugagcacgaagcggagccagcagaccgugaucccgaacaucggcucccgccccuggguccgcggggugagcucccggaucagcaucuacuggaccaucgugaagcccggcgacauccuccugaucaacuccaccgggaaccugaucgcgccccggggcuacuucaagauccgcagcggcaaguccagcaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcucaaccggcugaucgagaagaccaacgagaaguuccaccagaucgagaaggaguucagcgagguggaggggcgcauccaggaccuggagaaguacguggaggacacgaagaucgaccucugguccuacaacgccgagcugcugaucgcccucgagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacgucuaccgcgacgaggcccugaacaaccgguuccagaucaagggcguggagcucaagagcggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 61907 - RNA, 1701 nt, Artificial Sequence
  derived and/or modified sequence opt1 from hemagglutinin__InfluenzaA__ABE14464
augaagaccaucaucgcccugagcuacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaccaacgagggguucaacuggaccggcguggcccaggacgggaaguccuacgccugcaagcgcggcuccgugaacagcuucuucucccggcugaacuggcuccacaagcuggaguacaaguaccccgcgcugaacgucaccaugcccaacaacgacaaguucgacaagcucuacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccugcucaucaacuccaccgggaaccugaucgcgccccggggcuacuucaagauccgcaacggcaagagcuccaucaugcggagcgacgccccgaucgacaacugcaacuccgagugcaucacccccaacgggagcauccccaacgacaagcccuuccagaacgugaaccgcaucacguacggcgccugcccgcgguacgucaagcagaacacccugaagcucgccaccgggaugcgcaacgugcccgagaagcagacccggggcaucuucggggccaucgccggcuucaucgagaacggcugggaggggaugaucgacggcugguacggguuccgccaccagaacuccgagggcacggggcaggccgccgaccucaagagcacccaggcggccaucgaccagaucaacggcaagcugaaccggcugaucgagaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggacccgcaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcgugguccugcucggcuucaucaugugggccugccagaaggggaacauccgcugcaacaucugcaucuga

SEQ ID NO: 61908 - RNA, 1701 nt, Artificial Sequence
  derived and/or modified sequence opt1 from hemagglutinin__InfluenzaA__ABE14840
augaagaccaucaucgcccugagcuacauccucugccugguguucgcccagaagcugccccgcaacgacaacuccaccgcgacgcucugccugggccaccacgccgucccgaacgggacccuggugaagaccaucaccaacgaccagaucgaggugacgaacgccaccgagcucguccagagcuccagcaccggccggaucugcgacagcccccaccgcauccuggacgggaagaacugcacccugaucgacgcccuccugggcgacccccacugcgacggguuccagaacaaggagugggaccuguucguggagcggagcaaggccuacuccaacugcuaccccuacgacgugccggacuacgcgagccuccgcucccuggucgccagcuccggcacgcuggaguucaccaacgagggcuucaacuggaccgggguggcccaggacggcaagagcuacgccugcaagcggggguccgugaacagcuucuucucccgccucaacuggcugcacaagcuggaguacaaguaccccgcgcucaacgucaccaugcccaacaacgacaaguucgacaagcuguacaucuggggcgugcaccaccccagcacggacuccgaccagaccagccuguacgugcaggccuccgggcgggucaccgugagcaccaagcgcagccagcagacggugaucccgaacaucggcucccggcccuggguccgcggcaucagcucccggaucagcaucuacuggaccaucgugaagcccggggacauccuccugaucuccagcaccggcaaccugaucgcgccccgcggguacuucaagauccggaacggcaaguccagcaucaugcgcuccgacgccccgaucgacaacugcaacagcgagugcaucacccccaacggcuccauccccaacgacaagcccuuccagaacgugaaccggaucacguacggggccugcccgcgcuacgucaagcagaacacccucaagcuggccaccggcaugcggaacgugcccgagaagcagacccgcgggaucuucggcgccaucgccggguucaucgagaacggcugggagggcaugguggacgggugguacggcuuccggcaccagaacagcgaggggacgggccaggccgccgaccugaaguccacccaggcggccaucgaccagaucaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcugaaguccggguacaaggacuggauccucuggaucuccuucgccaucagcugcuuccugcugugcgucgugcuccugggcuucaucaugugggccugccagaagggcaacauccggugcagcaucugcaucuga

SEQ ID NO: 61909 - RNA, 1701 nt, Artificial Sequence
  derived and/or modified sequence opt1 from hemagglutinin__InfluenzaA__ABE15578
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcaacggcaagagcuccaucaugcggagcgacgccccgaucgacaacugcaacuccgagugcaucacccccaacgggagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagagcacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcagcaucugcaucuga

SEQ ID NO: 61910 - RNA, 1701 nt, Artificial Sequence
  derived and/or modified sequence opt1 from hemagglutinin__InfluenzaA__ABE26991
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucagccggggcuucggguccggcaucaucaccagcaacgccuccaugggcgacugcgacgccaagugccagaccccgcagggggccaucaacagcucccugcccuuccagaacgugcaccccgucaccaucggcgagugccccaaguacgugcgcagcacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacagcaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacagcgaggaguccacccucaagcgggagaagaucgacggcgucaagcuggagagcaugggcguguaccagauccuggccaucuacagcaccguggccuccagccucguccugcuggugucccucggggccaucagcuucuggaugugcuccaacggcagccugcagugccgcaucugcaucuga

SEQ ID NO: 61911 - RNA, 1701 nt, Artificial Sequence
  derived and/or modified sequence opt1 from hemagglutinin__InfluenzaA__ABF47550
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgagccugcggucccucgucgccagcuccggcacgcuggaguucaucaacgaggacuucaacuggaccggggugacccagagcggcggguccuacgccugcaagcgcggcagcgugaacuccuucuucagccggcugaacuggcuccacgaguccgaguacaaguaccccgcccugaacgucaccaugcccaacaacgggaaguucgacaagcuguacaucuggggcgugcaccaccccagcacggaccgcgagcagaccaaccucuacgugcgggcguccggccgcgucaccgugagcaccaagcggagccagcagacggugaucccgaacaucgggucccgccccuggguccggggccugagcucccgcaucagcaucuacuggaccaucgugaagcccggggacauccugcucaucaacuccaccggcaaccugaucgcgccccggggcuacuucaagauccgcaccgggaaguccuccaucaugcggagcgacgccccgaucggcacgugcuccagcgagugcaucacccccaacggguccauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgccggguucaucgagaacggcugggaggggaugguggacggcugguacggguuccggcaccagaacagcgagggcaccggccaggccgccgaccugaaguccacccaggccgcgaucgaccagaucaacgggaagcugaaccgccucaucgagaagacgaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucaccgacagcgagaugaacaagcuguucgagaagacgcgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaagggcguggagcucaagagcggguacaaggacuggauccuguggaucuccuucgccaucagcugcuuccugcugugcgucgugcugcucggcuucaucaugugggccugccagaaggggaacauccgcugcaacaucugcaucuga

SEQ ID NO: 61912 - RNA, 1698 nt, Artificial Sequence
  derived and/or modified sequence opt1 from hemagglutinin__InfluenzaA__ABF47561
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaagcugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61913 - RNA, 1698 nt, Artificial Sequence
  derived and/or modified sequence opt1 from hemagglutinin__InfluenzaA__ABF47572
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggacaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61914 - RNA, 1698 nt, Artificial Sequence; identical to SEQ ID NO: 61808
  derived and/or modified sequence opt1 from hemagglutinin__InfluenzaA__ABF47583

SEQ ID NO: 61915 - RNA, 1701 nt, Artificial Sequence
  derived and/or modified sequence opt1 from hemagglutinin__InfluenzaA__ABF47594
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccuacgccugcaagcgccggagcgugaaguccuucuucagccgccucaacuggcugcacaagcuggaguacaaguaccccgcgcagaacgucaccaugcccaacaacgacaaguucgacaagcucuacaucuggggcgugcaccaccccuccacggacagcgaccagaccucccuguacgugcaggccagcgggcgggucaccgugagcaccaagcgcucccagcagacggugaucccgaacaucgggagccggcccuggguccgcggcguguccagccggaucuccaucuacuggaccaucgugaagcccggcgacauccugcucaucaacagcaccgggaaccugaucgcgccccgcggcuacuucaagauccgguccgggaaguccuccaucaugcgcagcgacgccccgaucggcaacugcaacuccgagugcaucacccccaacggcagcauccccaacgacaagcccuuccagaacgucaaccggaucacguacggggccugcccgcgcuacgugaagcagaacacccugaagcucgccaccggcaugcggaacgugcccgagaagcagacccgcgggaucuucggcgccaucgccggguucaucgagaacggcugggagggcauggucgacgggugguacggcuuccggcaccagaacuccgaggggacgggccaggccgccgaccucaagagcacccaggcggccaucaaccagaucaacgggaagcugaaccgccugaucgagaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacacgaucgaccucaccgacuccgagaugaacaagcuguucgagcgcacccgcaagcagcugcgggagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggguacaaggacuggauccuguggaucagcuucgccaucagcugcuuccuccugugcguggugcugcucggcuucaucaugugggccugccagaagggcaacauccggugcaacaucugcaucuga

SEQ ID NO: 61916 - RNA, 1701 nt, Artificial Sequence
  derived and/or modified sequence opt1 from hemagglutinin__InfluenzaA__ABF47605
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccagcgggaaccugaucgcccccugguacgccuucgcgcucucccggggcuucgggagcggcaucaucaccuccaacgccagcaugggcgagugcgacgccaagugccagaccccgcagggggccaucaacuccagccugcccuuccagaacgugcaccccgucaccaucggcgagugccccaaguacgugcgcuccacgaagcugcggauggugaccgggcuccgcaacaucccgagcauccagucccggggccuguucggggccaucgcgggcuucaucgagggcggguggaccggcaugaucgacgggugguacggcuaccaccaccagaacgagcaggggagcggcuacgccgccgacaagaaguccacccagaacgccaucgacggcaucacgaacaaggucaacagcgugaucgagaagaugaacacccaguucaccgccguggggaaggaguucaacaagcuggagcgccggaucgagaaccucaacaagaaggucgacgacggcuuccuggacaucuggaccuacaacgcggagcugcucgugcugcuggagaacgagcgcacgcucgacuuccacgacuccaacgucaagaaccuguacgagaaggugaagaaccagcugaagaacaacgccaaggagaucgggaacggcugcuucgaguucuaccacaagugcaacaacgagugcauggagagcgugaagaacgggaccuacgacuaccccaaguacuccgaggagagcaagcucaagcgggagaagaucgacggcgucaagcuggagagcaugggcguguaccagauccuggccaucuacuccaccguggccagcucccucguccugcuggugagccucggggccaucuccuucuggaugugcagcaacggcucccugcagugccgcaucugcaucuga

SEQ ID NO: 61917 - RNA, 1701 nt, Artificial Sequence; identical to SEQ ID NO: 61901
  derived and/or modified sequence opt1 from hemagglutinin__InfluenzaA__ABF47616

SEQ ID NO: 61918 - RNA, 1701 nt, Artificial Sequence
  derived and/or modified sequence opt1 from hemagglutinin__InfluenzaA__ABF47627
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucagccggggcuucggguccggcaucaucaccagcaacgccuccaugggcgacugcgacgccaagugccagaccccgcagggggccaucaacagcucccugcccuuccagaacgugcaccccgucaccaucggcgagugccccaaguacgugcgcagcacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacagcaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacagcgaggaguccaagcucaagcgggagaagaucgacggcgucaagcuggagagcaugggcguguaccagauccuggccaucuacagcaccguggccuccagccucguccugcuggugucccucggggccaucagcuucuggaugugcuccaacggcagccugcagugccgcaucugcaucuga

SEQ ID NO: 61919 - RNA, 1701 nt, Artificial Sequence
  derived and/or modified sequence opt1 from hemagglutinin__InfluenzaA__ABF47638
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucaccaagcgccccaaggugcgggaccaggagggccgcaucaacuacuacuggacgcuccuggagcccggcgacaccaucaucuucgaggccaacgggaaccugaucgcccccugguacgccuucgcccucagccggggcuucggguccggcaucaucaccagcaacgcguccaugggcgagugcgacgccaagugccagaccccgcagggggccaucaacagcucccugcccuuccagaacgugcaccccgucacgaucggcgagugccccaaguacgugcgcagcaccaagcugcggauggugaccgggcuccgcaacaucccguccauccagagccggggccuguucggggccaucgccggcuucaucgagggcggguggaccggcaugaucgacgggugguacggcuaccaccaccagaacgagcagggguccggcuacgcggccgaccagaaguccacgcagaacgccaucgacggcaucaccaacaaggucaacagcgugaucgagaagaugaacacccaguucaccgccguggggaaggaguucaacaagcuggagcgccggauggagaaccucaacaagaaggucgacgacggcuuccuggacaucuggacguacaacgccgagcugcucgugcugcuggagaacgagcgcacccucgacuuccacgacagcaacgucaagaaccuguacgagaaggugaagacccagcugaagaacaacgcgaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacagcacgguggccuccagccucguccugcuggugucccucggggccaucagcuucuggaugugcuccaacggcagccugcagugccgcaucugcaucuga

SEQ ID NO: 61920 - RNA, 1701 nt, Artificial Sequence; identical to SEQ ID NO: 61919
  derived and/or modified sequence opt1 from hemagglutinin__InfluenzaA__ABF47649

SEQ ID NO: 61921 - RNA, 1701 nt, Artificial Sequence
  derived and/or modified sequence opt1 from hemagglutinin__InfluenzaA__ABF47660
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcauccaccaccccagcaacaucggggaccagcgggccaucuaccacaccgagaacgcguacgucagcgugguguccagccacuacucccgccgguucaccccggagaucgccaagcgccccaagguccgggaccaggagggccgcaucaacuacuacuggacccuccuggagcccggcgacacgaucaucuucgaggccaacgggaaccugaucgcccccugguacgccuucgcgcucagccggggcuucggguccggcaucaucaccagcaacgccuccaugggcgacugcgacgccaagugccagaccccgcagggggccaucaacagcucccugcccuuccagaacgugcaccccgugaccaucggcgagugccccaaguacguccgcagcacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggugaacagcgucaucgagaagaugaacacccaguucaccgccguggggaaggaguucaacaagcuggagcgccggauggagaaccucaacaagaagguggacgacggcuuccuggacaucuggaccuacaacgcggagcugcucguccugcuggagaacgagcgcacgcucgacuuccacgacagcaacgugaagaaccuguacgagaaggucaagacccagcugaagaacaacgccaaggagaucgggaacggcugcuucgaguucuaccacaagugcaacaacgagugcauggaguccgugaagaacgggaccuacgacuaccccaaguacagcgaggaguccaagcucaagcgggagaagaucgacggcgugaagcuggagagcaugggcgucuaccagauccuggccaucuacagcaccguggccuccagccucgugcugcuggucucccucggggccaucagcuucuggaugugcuccaacggcagccugcagugccgcaucugcaucuga

SEQ ID NO: 61922 - RNA, 1698 nt, Artificial Sequence
  derived and/or modified sequence opt1 from hemagglutinin__InfluenzaA__ABF47671
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuucgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 61923 - RNA, 1701 nt, Artificial Sequence
  derived and/or modified sequence opt1 from hemagglutinin__InfluenzaA__ABF47693
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcaacaucgccggcuggauccuggggaacccggagugcgagagccucuucuccaagaaguccuggagcuacaucgccgagacccccaacagcgagaacgggaccugcuaccccggcuacuucgccgacuacgaggagcugcgggagcagcuguccagcguguccagcuucgagcgcuucgagaucuuccccaaggagcgguccuggccgaagcacaacgucacccgcggcgugacggccagcugcucccacaagggcaagagcuccuucuaccggaaccuccuguggcugaccgagaagaacgggagcuaccccaaccucuccaagagcuacgugaacaacaaggagaaggagguccuggugcuguggggcgugcaccaccccagcaacaucgaggaccagaagaccaucuaccgcaaggagaacgccuacgucuccguggugagcuccaacuacaaccggcgcuucacccccgagaucgcggagcggccgaagguccgcgggcaggccggccggaucaacuacuacuggacgcuccuggagcccggcgacaccaucaucuucgaggccaacgggaaccugaucgcccccuggcacgccuucgcgcucaaccgcggcuucgggagcggcaucaucaccuccaacgccagcauggacgagugcgacaccaagugccagacgccccagggcgccaucaacuccagccugccguuccagaacauccaccccgugaccaucggggagugccccaaguacgugcgguccaccaagcugcgcauggucaccggccuccggaacauccccagcauccagucccgcgggcuguucggcgccaucgccggguucaucgagggcggcuggacggggaugaucgacggcugguacggguaccaccaccagaacgagcagggcagcggguacgcggccgaccagaaguccacccagaacgccaucaacggcaucaccaacaaggugaacagcgugaucgagaagaugaacacccaguucacggccgucggcaaggaguucaacaagcuggagaagcggauggagaaccucaacaagaagguggacgacggguuccuggacaucuggaccuacaacgccgagcugcucgugcugcuggagaacgagcgcacccucgacuuccacgacuccaacgucaagaaccuguacgagaaggucaagagccagcugaagaacaacgcgaaggagaucggcaacgggugcuucgaguucuaccacaagugcaacaacgagugcauggaguccgugaagaacggcaccuacgacuacccgaaguacagcgaggaguccaagcucaaccgggagaagaucgacggggugaagcuggagagcaugggcguguaccagauccuggccaucuacagcacggucgccuccagccucgugcugcuggugucccucggcgccaucagcuucuggaugugcuccaacgggagccugcagugccgcaucugcaucuga

SEQ ID NO: 61924 - RNA, 1701 nt, Artificial Sequence; identical to SEQ ID NO: 61923
  derived and/or modified sequence opt1 from hemagglutinin__InfluenzaA__ABF47704

SEQ ID NO: 61925 - RNA, 1701 nt, Artificial Sequence
  derived and/or modified sequence opt1 from hemagglutinin__InfluenzaA__ABF47715
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagcggagcuggccgaagcacaacgucacccgcggcgugacggccuccugcagccacaagggcaaguccagcuucuaccggaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccgcaaggagaacgccuacgucagcgugguguccagcaacuacaaccggcgcuucacccccgagaucgcggagcggccgaagguccgcgggcaggccggccggaucaacuacuacuggacgcuccuggagcccggcgacaccaucaucuucgaggccaacgggaaccugaucgcccccuggcacgccuucgcgcucaaccgcggcuucggguccggcaucaucaccagcaacgccuccauggacgagugcgacaccaagugccagacgccccagggcgccaucaacagcucccugccguuccagaacauccaccccgugaccaucggggagugccccaaguacgugcggagcaccaagcugcgcauggucaccggccuccggaacauccccuccauccagagccgcgggcuguucggcgccaucgccggguucaucgagggcggcuggacggggaugaucgacggcugguacggguaccaccaccagaacgagcagggcuccggguacgcggccgaccagaaguccacccagaacgccaucaacggcaucaccaacaaggugaacagcgugaucgagaagaugaacacccaguucacggccgucggcaaggaguucaacaagcuggagaagcggauggagaaccucaacaagaagguggacgacggguuccuggacaucuggaccuacaacgccgagcugcucgugcugcuggagaacgagcgcacccucgacuuccacgacagcaacgucaagaaccuguacgagaaggugaagucccagcugaagaacaacgcgaaggagaucggcaacgggugcuucgaguucuaccacaagugcaacaacgagugcauggagagcgucaagaacggcaccuacgacuacccgaaguacuccgaggagagcaagcucaaccgggagaagaucgacggggugaagcuggagagcaugggcguguaccagauccuggccaucuacuccacggucgccagcucccucgugcugcuggugagccucggcgccaucuccuucuggaugugcagcaacgggucccugcagugccgcaucugcaucuga

SEQ ID NO: 61926 - RNA, 1701 nt, Artificial Sequence; identical to SEQ ID NO: 61923
  derived and/or modified sequence opt1 from hemagglutinin__InfluenzaA__ABF47726

SEQ ID NO: 61927 - RNA, 1701 nt, Artificial Sequence; identical to SEQ ID NO: 61923
  derived and/or modified sequence opt1 from hemagglutinin__InfluenzaA__ABF47737

SEQ ID NO: 61928 - RNA, 1701 nt, Artificial Sequence
  derived and/or modified sequence opt1 from hemagglutinin__InfluenzaA__ABF47748
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagagcuccuggccgaagcacaacgucacccgcggggugacggccagcugcucccacaagggcaagagcuccuucuaccggaaccuccuguggcugaccgagaagaacgggagcuaccccaaccucagcaaguccuacgugaacaacaaggagaaggagguccuggugcuguggggcgugcaccaccccagcaacaucgaggaccagaagaccaucuaccggaaggagaacgccuacgucuccguggugagcucccacuacaaccgccgguucacccccgagaucgcgaagcgcccgaagguccgggaccaggaggggcgcaucaacuacuacuggacgcuccuggagcccggcgacaccaucaucuucgaggccaacggcaaccugaucgcccccugguacgccuucgcccucagccggggguucggcuccgggaucaucaccagcaacgcguccauggacgagugcgacgccaagugccagacgccccagggcgccaucaacagcucccugccguuccagaacgugcaccccgugaccaucggcgagugccccaaguacguccgcagcaccaagcugcggauggugaccgggcuccgcaacauccccuccauccagagccggggccuguucggggccaucgccggcuucaucgagggcggcuggaccggcaugaucgacgggugguacggcuaccaccaccagaacgagcagggguccggcuacgcggccgaccagaaguccacgcagaacgccaucaacgggaucaccaacaaggugaacagcgucaucgagaagaugaacacccaguucaccgccgugggcaaggaguucaacaagcuggagaagcgcauggagaaccucaacaagaagguggacgacggcuuccuggacaucuggacguacaacgccgagcugcucguccugcuggagaacgagcggacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuacccgaaguacagcgaggaguccaagcucaaccgcgagaagaucgacggcgugaagcuggagagcaugggggucuaccagauccuggccaucuacuccaccguggccagcucccucgugcugcuggucagccucggcgccaucuccuucuggaugugcagcaacggcucccugcagugccggaucugcaucuga

SEQ ID NO: 61929 - RNA, 1701 nt, Artificial Sequence
  derived and/or modified sequence opt1 from hemagglutinin__InfluenzaA__ABF47770
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggagcuacaucgccgagacccccaacagcgagaacgggaccugcuaccccggcuacuucgccgacuacgaggagcugcgcgagcagcuguccagcguguccagcuucgagcgguucgagaucuuccccaaggaguccagcuggccgaagcacaacgucaccaagggggugacggccuccugcagccacaagggcaaguccagcuucuaccgcaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccggaaggagaacgccuacgucagcgugguguccagccacuacaaccgccgguucacccccgagaucgcgaagcgcccgaagguccggaaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgagcauggacgagugcgacgccaagugccagacgccccagggcgccaucaacuccagccugccguuccagaacgugcaccccgugaccaucggcgagugccccaaguacguccgcuccaccaagcugcggauggugaccgggcuccgcaacauccccagcauccagucccggggccuguucggggccaucgccggcuucaucgagggcggcuggaccggcaugaucgacgggugguacggcuaccaccaccagaacgagcaggggagcggcuacgcggccgaccagaaguccacgcagaacgccaucaacgggaucaccaacaaggugaacagcaucaucgagaagaugaacacccaguucaccgccgucggcaaggaguucaacaagcuggagaagcgcauggagaaccucaacaagaagguggacgacggcuuccuggacaucuggacguacaacgccgagcugcucgugcugcuggagaacgagcggacccucgacuuccacgacuccaacgucaagaaccuguacgagaaggucaagagccagcugaagaacaacgcgaaggagaucgggaacggcugcuucgaguucuaccacaagugcaacaacgagugcauggaguccgugaagaacgggaccuacgacuacccgaaguacagcgaggagagcaagcucaaccgcgagaagaucgacggcgugaagcuggaguccauggggguguaccagauccuggccaucuacagcaccgucgccuccagccucgugcugcuggugucccucggcgccaucagcuucuggaugugcuccaacggcagccugcagugccggaucugcaucuga

SEQ ID NO: 61930 - RNA, 1701 nt, Artificial Sequence; identical to SEQ ID NO: 61929
  derived and/or modified sequence opt1 from hemagglutinin__InfluenzaA__ABF47781

SEQ ID NO: 61931 - RNA, 1701 nt, Artificial Sequence; identical to SEQ ID NO: 61929
  derived and/or modified sequence opt1 from hemagglutinin__InfluenzaA__ABF47792

SEQ ID NO: 61932 - RNA, 1701 nt, Artificial Sequence; identical to SEQ ID NO: 61929
  derived and/or modified sequence opt1 from hemagglutinin__InfluenzaA__ABF47803

SEQ ID NO: 61933 - RNA, 1701 nt, Artificial Sequence; identical to SEQ ID NO: 61929
  derived and/or modified sequence opt1 from hemagglutinin__InfluenzaA__ABF47814

SEQ ID NO: 61934 - RNA, 1701 nt, Artificial Sequence; identical to SEQ ID NO: 61929
  derived and/or modified sequence opt1 from hemagglutinin__InfluenzaA__ABF47825

SEQ ID NO: 61935 - RNA, 1701 nt, Artificial Sequence; identical to SEQ ID NO: 61929
  derived and/or modified sequence opt1 from hemagglutinin__InfluenzaA__ABF47836

SEQ ID NO: 61936 - RNA, 1701 nt, Artificial Sequence; identical to SEQ ID NO: 61929
  derived and/or modified sequence opt1 from hemagglutinin__InfluenzaA__ABF47847

SEQ ID NO: 61937 - RNA, 1701 nt, Artificial Sequence
  derived and/or modified sequence opt1 from hemagglutinin__InfluenzaA__ABF47858
augaagaccaucaucgcccugagcuacauccucugccugguguucgcccagaagcugcccggcaacgacaacgggaccgcgacgcucugccugggccaccacgccgucccgaacgggacccuggugaagaccaucaccaacgaccagaucgaggugacgaacgccaccgagcucguccaguccagcuccaccggccgcaucugcgacagcccccaccggauccuggacgggaagaacugcacccugaucgacgcccuccugggcgacccccacugcgacggcuuccagaacaaggagugggaccuguucguggagcgcuccaaggccuacagcaacugcuaccccuacgacgugccggacuacgcgucccuccggagccuggucgccuccagcgggacgcuggaguucaucaacgaggacuucaacuggaccggcguggcccaggacgggaaguccuacgccugcaagcgcggcagcgugaacuccuucuucagccggcucaacuggcugcacaagcuggaguacaaguaccccgcgcucaacgucaccaugcccaacaacgggaaguucgacaagcuguacaucuggggcgugcaccaccccuccaccgacagcgaccagacgucccuguacgugcgcgccagcggccgggucaccguguccaccaagcgcagccagcagaccgugaucccgaacaucggguuccggcccuggguccgcggccucagcucccggaucagcaucuacuggacgaucgugaagcccggggacauccugcugaucaacuccaccggcaaccucaucgcgccccgcggcuacuucaagauccggaacggcaagagcuccaucaugcgcagcgacgccccgaucgggaacugcuccagcgagugcaucacccccaacggguccauccccaacgacaagcccuuccagaacgugaaccggaucaccuacggcgccugcccgcgcuacgucaagcagaacacgcugaagcuggccaccgggaugcggaacgugcccgagaagcagacccgcggcaucuucggcgccaucgccggguucaucgagaacggcugggaggggaugguggacggcugguacggguuccggcaccagaacagcgagggcaccggccaggccgccgaccucaaguccacgcaggcggccaucgaccagaucaacgggaagcugaaccgccugaucgagaagaccaacgagaaguuccaccagaucgagaaggaguucagcgaggucgagggccggauccaggaccucgagaaguacguggaggacaccaagaucgaccugugguccuacaacgccgggcugcucguggcccuggagaaccagcacaccaucgaccugacggacagcgagaugaacaagcuguucgagcgcacccgcaagcagcuccgggagaacgccgaggacaugggcaacgggugcuucaagaucuaccacaagugcgacaacgcgugcaucggcuccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 61938 - RNA, 1698 nt, Artificial Sequence; identical to SEQ ID NO: 61750
  derived and/or modified sequence opt1 from hemagglutinin__InfluenzaA__ABF47869

SEQ ID NO: 61939 - RNA, 1698 nt, Artificial Sequence; identical to SEQ ID NO: 61750
  derived and/or modified sequence opt1 from hemagglutinin__InfluenzaA__ABF47880

SEQ ID NO: 61940 - RNA, 1698 nt, Artificial Sequence
  derived and/or modified sequence opt1 from hemagglutinin__InfluenzaA__ABF47891
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucacccggaagaacgggcuguaccccaaccugagcaaguccuacgccaacaacaaggagaaggaggugcucguccuguggggcgugcaccacccgcccaacaucggggaccagcgcgcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggcgacaccaucaucuucgaggcgaacgggaaccugaucgccccgcgcuacgccuucgcccucucccggggcuucgggagcggcaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggguucaucgagggcggcuggaccgggaugguggacggcugguacggguaccaccaccagaacgagcagggcuccggguacgcggccgaccagaaguccacccagaacgccaucaacggcaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggcgccaucuccuucuggaugugcagcaacgggucccugcagugccgcaucugcaucuga

SEQ ID NO: 61941 - RNA, 1701 nt, Artificial Sequence
  derived and/or modified sequence opt1 from hemagglutinin__InfluenzaA__ABF47902
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagagcggggacauccuccugaucaacugcaccggcaaccugaucgcgccccgcggguacuucaagauccgguccggcaagagcuccaucaugcgcagcgacgccuccaucggcaagugcaacagcgagugcaucaccccgaacggguccauccccaacgacaagcccuuccagaacgugaaccggaucaccuacggcgccugcccccgcuacgugaagcagaacacgcucaagcuggccaccgggaugcggaacgucccggagaagcagacccgcggcaucuucggggccaucgccggcuucaucgagaacggcugggaggggaugguggacggcugguacggguuccggcaccagaacagcgagggcaccgggcaggccgcggaccugaaguccacgcaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggcuucaucaugugggccugccagaaggggaacauccgcugcaacaucugcaucuga

SEQ ID NO: 61942 - RNA, 1698 nt, Artificial Sequence
  derived and/or modified sequence opt1 from hemagglutinin__InfluenzaA__ABF47955
augaaggccaagcugcucgugcugcuguacgccuucgucgcgaccgacgccgacaccaucugcaucggcuaccacgccaacaacagcacggacaccguggacaccaucuucgagaagaacguggccgucacccacuccgugaaccuccuggaggaccgccacaacgggaagcugugcaagcucaagggcaucgcgccccugcagcuggggaagugcaacaucacgggcuggcuccuggggaacccggagugcgacagccugcuccccgcccgguccuggagcuacaucguggagacccccaacuccgagaacggcgccugcuaccccggcgacuucaucgacuacgaggagcugcgcgagcagcugagcuccgucagcucccucgagcgguucgagaucuucccgaaggagagcuccuggcccaaccacaccuucaacggggugaccgugagcugcucccaccgcggcaagagcuccuucuaccggaaccugcuguggcucacgaagaagggggacagcuaccccaagcugaccaacuccuacgucaacaacaagggcaaggaggugcuggugcucuggggcguccaccaccccagcuccagcgacgagcagcagagccuguacuccaacgggaacgccuacgugagcguggccuccagcaacuacaaccgccgguucaccccggagaucgcggcccgccccaaggucaaggaccagcacggccggaugaacuacuacuggacccugcucgagcccggggacacgaucaucuucgaggccaccggcaaccugaucgcccccugguacgccuucgcgcugucccgcggguucgagagcggcaucaucaccuccaacgccagcaugcacgagugcaacaccaagugccagacgccgcagggcuccaucaacagcaaccuccccuuccagaacauccaccccgugaccaucggggagugccccaaguacgugcgguccaccaagcugcgcauggucaccggccugcggaacaucccgagcauccaguaccgcggccucuucggggccaucgccggguucaucgagggcggcuggacggggaugaucgacggcugguacggguaccaccaccagaacgagcagggcuccggguacgccgcggaccagaaguccacccagaacgccaucaaccggaucaccaacaaggugaacagcgugaucgagaagaugaacacccaguucacggccgucggcaaggaguucaacaaccuggagaagcgcauggagaaccugaacaagaagguggacgacggcuuccucgacaucuggaccuacaacgccgagcugcuggugcuccuggagaacgagcggacccuggacuuccacgaccucaacgucaagaaccuguacgagaaggucaagagccagcugaagaacaacgccaaggagaucgggaacggcugcuucgaguucuaccacaagugcgacaacgagugcauggaguccgugcgcaacgggaccuacgacuaccccaaguacagcgaggaguccaagcucaaccgggagaagaucgacggcgugaagcuggagagcauggggguguaccagauccuggcgaucuacagcacggucgccuccagccucgugcugcuggugucccucggcgccaucagcuucuggaugugcuccaacggcagccugcagugccgcaucugcaucuga

SEQ ID NO: 61943 - RNA, 1698 nt, Artificial Sequence
  derived and/or modified sequence opt1 from hemagglutinin__InfluenzaA__ABF60576
augaagaccaccaucauccugauccuccugacgcacgccguggacagccagaaccccaucuccggcaacaacaccgccacccugugccucgggcaccacgcggucgccaacggcacccuggugaagacgaucaccgacgaccagaucgaggugaccaacgccaccgagcugguccagagcacguccaucgggaagaucugcaacaacccguaccgcgugcucgacggccggaacugcacccugaucgacgccaugcugggggacccccacugcgacguguuccaguacgagaacugggaccucuucaucgagcgcagcuccgccuucagcaacugcuaccccuacgacauccccgacuacgcgucccugcggagcaucgucgccuccagcggcacccuggaguucaccgccgagggcuucacguggaccggggugacccagaacggcggguccggcgccugccgccgggggagcgcggacuccuucuucagccgccucaacuggcugaccaaguccggcaacagcuacccgacgcugaacgugaccaugcccaacaacgacaacuucgacaagcucuacaucuggggcauccaccaccccuccaccaacaacgagcagaccaagcuguacguccaggagcuggggcgggugacggugagcaccaagcgcucccagcagaccaucauccccaacaucggcagccggccggggguccgcggccaggccggccggaucagcaucuacuggaccaucgugaagcccggggacauccucaugaucaacuccaacggcaaccugguggcgccccgcggguacuucaagaugcggacgggcaagagcuccaucaugcgcagcgacgcccccaucgacacgugcugguccgagugcaucaccccgaacgggagcauccccaacgacaagcccuuccagaacgucaacaaggugaccuacggcaagugccccaaguacaucaagcagaacacccugaagcucgccaccggcaugcggaacgugccggagaagcagauccgcgggaucuucggcgccaucgccggguucaucgagaacggcugggaggggauggucgacggcugguacggcuuccgguaccagaacuccgaggggaccggccaggccgccgaccucaagagcacccaggccgcgaucgaccagaucaacgggaagcugaaccgcgugaucgagcggacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacgccgagaugaacaagcuguucgagaagacgcggcgccagcugcgcgagaacgccgaggacaugggcgggggcugcuucaagaucuaccacaagugcgacaacgcgugcaucggguccauccggaacggcaccuacgaccacuacaucuaccgcgacgaggcccugaacaaccgguuccagaucaaggggguggagcucaagagcggcuacaaggacuggauccuguggaucuccuucgccaucagcugcuuccugaucugcgucgugcuccugggcuucaucaugugggccugcgagaaggggaacauccgcugcaacaucugcaucuga

SEQ ID NO: 61944 - RNA, 1701 nt, Artificial Sequence
  derived and/or modified sequence opt1 from hemagglutinin__InfluenzaA__ABF60577
augaagaccaucaucgugcugagcuacuucuucugccucgcccugucccaggacuacagcgaguccaacaacagcaccgccacgcugugccucggccaccacgcgguccccaacgggaccaucgugaagaccaucaccgacgaccagaucgaggugacgaacgccaccgagcugguccaguccagcuccaccggcaagaucugcaacaacccgcaccgcauccuggacgggcgggacugcacccucaucgacgcccugcugggcgacccccacugcgacguguuccaggacgagacgugggaccucuacguggagcgcagcuccgccuucagcaacugcuaccccuacgacguccccgacuacgccucccugcggagccugguggcguccagcgggacccucgaguucaucaccgagggcuucaccuggacgggcgugacccagaacgggggcuccaacgccugcaagcgcgggccggccagcggcuucuucucccggcugaacuggcugaccaagagcggguccaccuaccccguccucaacgugacgaugcccaacgacgacaacuucgacaagcuguacguguggggcguccaccaccccagcaccaaccaggagcagaccgaccuguacgugcaggccagcggccgcgugaccgucuccacgcggcgcagccagcagaccaucaucccgaacaucgggucccggcccugggugcgcggccagagcgggcggaucuccaucuacuggaccaucgugaagcccggcgacguccucgugaucaacagcaacggcaaccugaucgcgccccgcggguacuucaagauccggaccggcaaguccagcaucaugcgcuccgacgccccgaucgacacgugcaucagcgagugcaucacccccaacggguccauccccaacgacaagcccuuccagaacgugaacaagaucaccuacggcgccugcccgaaguacgucaagcagagcacccugaagcucgccacggggaugcggaacgugcccgagaagaagacccgcggccuguucguggccaucgcgggcuucaucgagaacgggugggagggcaugaucgacugcugguacggguuccggcaccagaacuccgagggcaccgggcaggccgccgaccucaagagcacccaggccgccaucgaccagaucaacggcaagcugaaccgcgucaucgagaagacgaacgagaaguuccaccagaucgagaaggaguucuccgagguggagggccggauccaggaccuggagaacuacgucgaggacaccaagaucgaccuguggagcuacaacgcggagcuccugguggcccuggagaaccagcacaccaucgaccucaccgacuccgagaugaacaagcuguucgagcgcacgcggcgccagcugcgcgagaacgccgaggacauggggagcggcugcuucaagaucuaccacaagugcgacaacgccugcaucgaguccauccggaacgggaccuacgaccacgacaucuaccgcgacgaggcccucaacaaccgguuccagaucaagggcguggagcucaagagcggguacaaggacuggauccuguggaucagcuucgcgaccuccugcuuccugcugugcgucgugcugggcggcuucaucaugugggccugccagcgcgggaacauccggugcaacaucugcaucuga

SEQ ID NO: 61945 - RNA, 1701 nt, Artificial Sequence
  derived and/or modified sequence opt1 from hemagglutinin__InfluenzaA__ABF60578
augaagaccaucaucgugcugagcugcuucuucugccucgccuucucccaggaccugagcgagaacaacaacaacaccgccacgcugugccucggccaccacgcgguccccaacgggaccaucgugaagaccaucaccgacgaccagaucgaggugacgaacgccaccgagcugguccaguccagcuccaccggcaagaucugcaacaacccgcaccgcauccuggacgggcgggacugcacccucaucgacgcccugcugggcgacccccacugcgacguguuccaggacgagacgugggaccucuacguggagcgcagcaaguccuucagcaacugcuaccccuacgacguccccgacuacgccucccugcggagccugguggccuccagcgggacccucgaguucaucaccgaggcguucaccuggacgggcgugacccagaacggcggguccggcgccugcaagcgcgggccgggcaacggguucuucagccggcugaacuggcugaccaaguccggcagcgccuaccccguccucaacgugaccaugcccaacaacgacaacuucgacaagcuguacguguggggcguccaccaccccuccacgaaccaggagcagaccaaccuguacgugcaggccagcgggcgcgugaccgucuccacccggcgcagccagcagacgaucaucccgaacaucggcagccggcccugggugcgcgggcagucccggcgcaucagcaucuacuggaccaucgugaagcccggcgacauccucgucaucaacuccaacggcaaccugaucgcgccccggggguacuucaagaugcgcaccggcaagagcuccaucaugcggagcgacgccccgaucgacacgugcaucuccgagugcaucacccccaacgggagcauccccaacgacaagcccuuccagaacgugaacaagaucaccuacggcgccugcccgaaguacaucaagcaguccacccugaagcucgccaccgggaugcgcaacgugcccgagaagcagacgcggggccuguucggcgccaucgcgggguucaucgagaacggcugggaggggaugaucgacggcugguacggguuccgccaccagaacagcgagggcaccggccaggccgccgaccugaaguccacccaggccgccaucgaccagaucaacgggaagcucaaccgggucaucgagaagaccaacgagaaguuccaccagaucgagaaggaguucagcgagguggagggccgcauccaggaccuggagaaguacguggaggacacgaagaucgaccugugguccuacaacgcggacguccucguggcccuggagaaccagcacaccaucgaccugaccgacagcgagaugaacaagcuguucgagaagacccggcgccagcuccgcgagaacgccgaggacauggggaacggcugcuucaagaucuaccacaagugcgacaacgccugcaucgaguccauccggaacgggacguacgaccacgacaucuaccgcgacgaggcccugaacaaccgguuccagaucaagggcugcggcgucaagagcggguacaaggacuggauccucuggaucuccuucgcgaucagcugcuuccugcugugcguggugcuccugggcuucaucaugugggccugccagcgcgggaacauccggugcaacaucugcaucuga

SEQ ID NO: 61946 - RNA, 1701 nt, Artificial Sequence
  derived and/or modified sequence opt1 from hemagglutinin__InfluenzaA__ABF60579
augaagacccugaucgcccucagcuacaucuucugccuggugcugggccaggaccuccccgggaacggcaacuccaccgccacgcugugccuggggcaccacgcggucccgaacggcacccucgugaagaccaucaccgacgaccagaucgaggugacgaacgccaccgagcugguccagaacuucagcauggacaagaucugcaacaacccccaccgcauccuggacggggccaacugcacccucaucgacgcccugcugggcgacccccacugcgacgacuuccagaacgagaagugggaccucuucguggagcgguccaaggccuucagcaacugcuaccccuacgacgugccggacuacaccucccugcgcagccugaucgcguccagcggcacgcucgaguucaucaacgaggacuucaacuggaccggggucacccagaacggcggguccaacgccugcaagcggggccccgacagcuccuucuucagccgccugaacuggcuguacaaguccgggaacaccuaccccaugcucaacgugacgaugcccaacagcgacaacuucgacaagcuguacaucuggggcgugcaccacccguccaccgcccgggagcagaccaaccuguacguccaggccagcggcaaggugaccguguccacgaagcgcagccagcagaccaucauccccaacaucgggucccggcccuggguccgcggccucagcagccggaucuccaucuacuggaccaucgugaagcccggggacauccuggugaucaacagcaacggcaaccugaucgcgccgcgcggcuacuucaagaugcacaccgggcgguccagcaucaugcgcuccgacgcccccaucgacacgugcagcuccgagugcaucacccccaacggcagcauccccaacgacaagccguuccagaacgucaacaagaucaccuacggggccugccccaaguacgugaagcagaacacccucaagcuggccacgggcaugcggaacauccccgagaagcagacccgcgggaucuucggcgccaucgcgggcuucaucgagaacgggugggagggcaugguggacgggugguacggcuuccggcaccagaacuccgaggggaccggccaggccgccgaccucaagagcacccaggccgccaucgaccagaucaacggcaagcugaaccgcgucaucgagaagacgaacgagaaguuccaccagaucgagaaggaguucuccgggguggagggccggauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcgccggcagcugcgcgagaacgccgaggacauggggaacggcugcuucaagaucuaccacaagugcgacaacgccugcaucgagagcauccggaacgggaccuacgaccacaacgaguaccgcgacgaggcccucaacaaccgcuuccagaucaagggcguggagcugaaguccggcuacaaggacuggauccuguggaucagcuucgcgaucuccugcuuccuccugugcgugguccugcucggguucaucaugugggccugccagaagggcaacauccggugcaacaucugcaucuga

SEQ ID NO: 61947 - RNA, 1701 nt, Artificial Sequence
  derived and/or modified sequence opt1 from hemagglutinin__InfluenzaA__ABF60580
augaagaccaucaucgcccugagcuacaucuucugccucgccuucgcgcaggaccugcccggcaacgacaacuccaccgccacgcugugccucgggcaccacgccgugccgaacggcacccuggucaagaccaucaccaacgaccagaucgaggugacgaacgccaccgagcuggugcagagcuccagcaccgggaagaucugcgacaacccccaccgcauccucgacggcaucaacugcacccugaucgacgcccugcucggggacccccacugcgacggcuuccagaacgagaagugggaccuguucgucgagcgguccaaggcguucagcaacugcuaccccuacgacgugccggacuacgccucccugcgcagccucguggccuccagcggcacgcuggaguucaucaacgagggguucaacuggaccggcgucacccagaacgggggcuccagcgccugcaagcgggggcccgacaacggcuucuucucccgccugaacuggcucuacaagagcggcuccaccuaccccgugcagaacgugacgaugcccaacaacgacaacagcgacaagcuguacaucuggggcguccaccacccguccaccgacaaggagcagaccgaccuguacgugcaggcgagcgggaaggugaccgucuccacgaagcggauccagcagaccgugauccccaacguggggagccgccccuggguccggggccucagcucccgcgugagcaucuacuggaccaucgugaagcccggcgacguccuggugaucaacuccaacgggaaccugaucgccccgcggggcuacuacaagaugcgcaccggcaagagcuccaucaugcggagcgacgcccccaucgggacgugcuccagcgagugcaucacccccaacggguccauccccaacgacaagccguuccagaacgugaacaagaucaccuacggcgccugccccaaguacgucaagcagaacacccucaagcuggccacgggcaugcgcaacgugcccgagaagcagacccgggggaucuucggcgcgaucgccggguucaucgagaacggcugggaggggaugaucgacggcugguacggcuuccgccaccagaacagcgaggggaccggccaggccgccgaccugaaguccacccaggccgcgaucgaccagaucaacgggaagcucaaccgggugaucgagaagacgaacgagaaguuccaccagaucgagaaggaguucagcgaggucgagggccgcauccaggaccuggagaaguacguggaggacaccaagaucgaccugugguccuacaacgccgagguccucguggcccuggagaaccagcacaccaucgaccugaccgacagcgagaugaacaagcuguucgagaagacgcggcgccagcuccgggagaacgccgaggacauggggaacggcugcuucaagaucuaccacaagugcgacaacgccugcaucggcuccauccgcaacgggaccuacgaccacgacguguaccgggacgaggcgcugaacaaccgcuuccagaucaagggcgucgagcucaagagcggguacaaggacuggauccuguggaucuccuucgccaucagcugcuuccugcucugcguggugcugcugggcuucaucaugugggccugccagaagggcaacauccgcugcaacaucugcaucuga

SEQ ID NO: 61948 - RNA, 1701 nt, Artificial Sequence
  derived and/or modified sequence opt1 from hemagglutinin__InfluenzaA__ABF60581
augaagaccaucaucgugcugagcuacuucuucugccucgcccugucccaggacuacagcgaguccaacaacagcaccgccacgcugugccucggccaccacgcgguccccaacgggaccaucgugaagaccaucaccgacgaccagaucgaggugacgaacgccaccgagcugguccaguccagcuccaccggcaagaucugcaacaacccgcaccgcauccuggacgggcgggacugcacccucaucgacgcccugcugggcgacccccacugcgacguguuccaggacgagacgugggaccucuacguggagcgcagcuccgccuucagcaacugcuaccccuacgacguccccgacuacgacucccugcggagccugguggccuccagcgggacccucgaguucaucaccgagggcuucaccuggacgggcgugacccagaacgggggcuccaacgcgugcaagcgcgggccggccagcggcuucuucucccggcugaacuggcugaccaagagcggguccaccuaccccguccucaacgugacgaugcccaacaacgacaacuucgacaagcuguacguguggggcguccaccaccccagcaccaaccaggagcagaccaaccuguacgugcaggccagcggccgcgugaccgucuccacgcggcgcagccagcagaccaucaucccgaacaucgggucccggcccugggugcgcggccagagcgggcggaucuccaucuacuggaccaucgugaagcccggcgacguccucgugaucaacagcaacggcaaccugaucgcgccccgcggguacuucaagaugcggaccggcaaguccagcaucaugcgcuccgacgccccgaucgacacgugcaucagcgagugcaucacccccaacggguccauccccaacgacaugcccuuccagaacgugaacaagaucaccuacggcgccugcccgaaguacgucaagcaggggacccugaagcucgccacgggcaugcggaacgugcccgagaagcagacccgcggccuguucggggccaucgccggcuucaucgagaacgggugggagggcaugaucgacgggugguacggcuuccggcaccagaacagcgagggcaccgggcaggcggccgaccugaaguccacccaggccgccaucgaccagaucaacggcaagcucaaccgcgugaucgagaagacgaacgagaaguuccaccagaucgagaaggaguucagcgaggucgaggggcggauccaggaccuggagaaguacguggaggacaccaagaucgaccugugguccgacaacgccgagcuccuggucgcgcuggagaaccagcacaccaucgaccucaccgacagcgagaugaacaagcuguucgagaagacgcgccggcagcugcgcgagaacgccgaggugaugggcaacgggugcuucaagaucuaccacaagugcgacaacgccugcaucgaguccauccgcaacggcaccuacgaccacgacaucuaccgggacgaggcccucaacaaccgcuuccagaucaagggcguggagcucaagagcggguacaaggacuggauccuguggaucuccuucgccaucagcugcuuccugcugugcgucgugcugcucggcuucaucaugugggcgugccagcgggggaacauccgcugcaacaucugcaucuga

SEQ ID NO: 61949 - RNA, 1701 nt, Artificial Sequence; identical to SEQ ID NO: 61748
  derived and/or modified sequence opt1 from hemagglutinin__InfluenzaA__ABF82651

SEQ ID NO: 61950 - RNA, 1698 nt, Artificial Sequence; identical to SEQ ID NO: 61808
  derived and/or modified sequence opt1 from hemagglutinin__InfluenzaA__ABF82662

SEQ ID NO: 61951 - RNA, 1698 nt, Artificial Sequence
  derived and/or modified sequence opt1 from hemagglutinin__InfluenzaA__ABF82673
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaagggcuccuggagcuacaucgucgagacccccaaccccgagaacggcacgugcuaccccggguacuucgccgacuacgaggagcugcgcgagcagcucuccagcguguccagcuucgagcgguucgagaucuucccgaagggcuccagcuggcccaaccacaccgugaccggggucuccgccagcugcucccacaacggcaagagcuccuucuaccgcaaccugcuguggcucaccgggaagaacggccuguaccccaaccugagcauguccuacgugaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggcuucgggagcggcaucaucacguccaacgcccccaugggggagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccggggccuguucggggccaucgccggcuucaucgagggcggguggaccgggaugguggacggcugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacggcucccugcagugccgcaucugcaucuga

SEQ ID NO: 61952 - RNA, 1698 nt, Artificial Sequence; identical to SEQ ID NO: 61849
  derived and/or modified sequence opt1 from hemagglutinin__InfluenzaA__ABF82684

SEQ ID NO: 61953 - RNA, 1701 nt, Artificial Sequence; identical to SEQ ID NO: 61815
  derived and/or modified sequence opt1 from hemagglutinin__InfluenzaA__ABF82695

SEQ ID NO: 61954 - RNA, 1701 nt, Artificial Sequence; identical to SEQ ID NO: 61791
  derived and/or modified sequence opt1 from hemagglutinin__InfluenzaA__ABF82706

SEQ ID NO: 61955 - RNA, 1698 nt, Artificial Sequence; identical to SEQ ID NO: 61307
  derived and/or modified sequence opt1 from hemagglutinin__InfluenzaA__ABF82819

SEQ ID NO: 61956 - RNA, 1698 nt, Artificial Sequence; identical to SEQ ID NO: 61808
  derived and/or modified sequence opt1 from hemagglutinin__InfluenzaA__ABF82830

SEQ ID NO: 61957 - RNA, 1698 nt, Artificial Sequence; identical to SEQ ID NO: 61808
  derived and/or modified sequence opt1 from hemagglutinin__InfluenzaA__ABF82841

SEQ ID NO: 61958 - RNA, 1698 nt, Artificial Sequence; identical to SEQ ID NO: 61808
  derived and/or modified sequence opt1 from hemagglutinin__InfluenzaA__ABF82852

SEQ ID NO: 61959 - RNA, 1698 nt, Artificial Sequence
  derived and/or modified sequence opt1 from hemagglutinin__InfluenzaA__ABF82863
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguucuacgugaacaacaaggagaaggaggugcucguccuguggggcgugcaccacccgcccaacaucggcgaccagcgggcccuguaccacacggagaacgccuacguguccgucgugagcagccacuacucccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucagccggggcuucggcuccgggaucaucacgagcaacgcccccaugggcgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggcgccaucgccggguucaucgagggcggguggaccggcaugguggacgggugguacggcuaccaccaccagaacgagcagggcagcggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagagccagcugaagaacaacgcgaaggagaucgggaacggcugcuucgaguucuaccacaagugcaacaacgagugcauggaguccgugaagaacggcaccuacgacuaccccaaguacagcgaggaguccaagcucaaccgggagaagaucgacggggugaagcuggagagcaugggcgucuaccagauccuggccaucuacuccacgguggccagcagccucgugcugcuggucucccucggggccaucagcuucuggaugugcuccaacggcagccugcagugccgcaucugcaucuga

SEQ ID NO: 61960 - RNA, 1698 nt, Artificial Sequence
  derived and/or modified sequence opt1 from hemagglutinin__InfluenzaA__ABF82874
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcgaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaucaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61961 - RNA, 1698 nt, Artificial Sequence; identical to SEQ ID NO: 61808
  derived and/or modified sequence opt1 from hemagglutinin__InfluenzaA__ABF82885

SEQ ID NO: 61962 - RNA, 1698 nt, Artificial Sequence; identical to SEQ ID NO: 61808
  derived and/or modified sequence opt1 from hemagglutinin__InfluenzaA__ABF82896

SEQ ID NO: 61963 - RNA, 1698 nt, Artificial Sequence; identical to SEQ ID NO: 61808
  derived and/or modified sequence opt1 from hemagglutinin__InfluenzaA__ABF82907

SEQ ID NO: 61964 - RNA, 1698 nt, Artificial Sequence; identical to SEQ ID NO: 61852
  derived and/or modified sequence opt1 from hemagglutinin__InfluenzaA__ABF82929

SEQ ID NO: 61965 - RNA, 1698 nt, Artificial Sequence; identical to SEQ ID NO: 61808
  derived and/or modified sequence opt1 from hemagglutinin__InfluenzaA__ABF82940

SEQ ID NO: 61966 - RNA, 1701 nt, Artificial Sequence
  derived and/or modified sequence opt1 from hemagglutinin__InfluenzaA__ABF83447
augaagaccaucaucgcccugagcuacaucuucugccucgcccugggccaggaccugcccgggaacgacaacaacaccgcgacgcucugccugggccaccacgccgugccgaacgggacccuggucaagaccaucaccgacgaccagaucgaggugacgaacgccaccgagcucgugcaguccagcuccaccggcaagaucugcaacaacccccaccgcauccuggacgggaucgacugcacccugaucgacgcccuccugggcgacccccacugcgacgucuuccagaacgagacgugggaccuguucguggagcggagcaaggccuucuccaacugcuaccccuacgacgugccggacuacgcgagccuccgcucccuggucgccagcuccggcacccuggaguucaucaccgagggguucaccuggacgggcgugacccagaacgggggcagcaacgccugcaagcgggggcccggcuccggcuucuucagccgccucaacuggcugaccaaguccgggagcaccuaccccgugcugaacgucacgaugcccaacaacgacaacuucgacaagcucuacaucuggggcgugcaccacccguccaccaaccaggagcagaccagccuguacgugcaggccuccgggggcgucaccgugagcacgcggcgcucccagcagaccaucauccccaacaucggcagccggcccugggugcgcgggcugagcucccggaucagcaucuacuggaccaucgucaagcccggcgacgugcucgugaucaacuccaacgggaaccugaucgcgccgcgcggcuacuucaagaugcggaccggcaagagcuccaucaugcgcagcgacgcccccaucgacacgugcaucuccgagugcaucacccccaacgggagcauccccaacgacaagccguuccagaacgucaacaagaucaccuacggcgccugccccaaguacgugaagcagaacacccugaagcucgccacggggaugcggaacgugcccgagaagcagacccgcggccuguucggggccaucgcgggcuucaucgagaacgggugggagggcaugaucgacggcugguacggguuccggcaccagaacuccgagggcaccgggcaggccgccgaccucaagagcacccaggccgccaucgaccagaucaacggcaagcugaaccgcgucaucgagaagacgaacgagaaguuccaccagaucgagaaggaguucuccgagguggaggggcggauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcgccggcagcugcgcgagaacgccgaggacaugggcaacggcugcuucaagaucuaccacaagugcgacaacgccugcaucgagagcauccggaacgggaccuacgaccacgacguguaccgcgacgaggcccucaacaaccgcuuccagaucaagggcgucgagcugaaguccggguacaaggacuggauccuguggaucagcuucgcgaucuccugcuuccuccugugcguggugcugcucggcuucaucaugugggccugccagcggggcaacauccgcugcaacaucugcaucuga

SEQ ID NO: 61967 - RNA, 1644 nt, Artificial Sequence
  derived and/or modified sequence opt1 from hemagglutinin__InfluenzaA__ABG20468
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggggagaagaucaacccggccaacgaccugugcuaccccggcaacuucaacgacuacgaggagcucaagcaccuccugagccggaucaaccacuucgagaagauccagaucauccccaaguccagcugguccgaccacgaggccagcuccggggugagcuccgccugccccuaccagggccgcagcuccuucuuccggaacguggucuggcugaucaagaagaacaacgcguacccgaccaucaagcgcagcuacaacaacacgaaccaggaggaccugcuggugcucuggggcauccaccaccccaacgacgccgccgagcagacccggcuguaccagaaccccaccaccuacaucuccguggggacgagcacccugaaccagcgccucguccccaagaucgccacccgguccaaggugaacggccagagcgggcgcauggaguucuucuggaccauccugaagccgaacgacgcgaucaacuucgaguccaacggcaacuucaucgcccccgagaacgccuacaagaucgugaagaagggggacagcacgaucaugaaguccgagcuggaguacggcaacugcaacaccaagugcgagacccccaucggcgccaucaacagcagcaugcccuuccacaacauccacccgcucaccaucggggagugccccaaguacgucaaguccaaccggcuggugcuggccacgggccuccgcaacagcccccagggggagcggcgccggaagaagcgcggccuguucggcgcgaucgccggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacccaguucgaggcgguggggcgggaguucaacaaccuggagcgccggaucgagaaccucaacaagaagauggaggacggcuuccuggacgucuggacguacaacgccgagcugcucgugcugauggagaacgagcgcacccuggacuuccacgacuccaacgugaagaaccucuacgacaagguccggcugcagcugcgcgacaacgccaaggagcucgggaacggcugcuucgaguucuaccaccggugcgacaacgagugcauggagagcgugcgcaacggcaccuacgacuacccccaguacuccgaggaggcccgccugaagcgggaggagaucagcggggucaagcuggaguccaucggcaccuaccagauccucagcaucuacuccacgguggccagcucccuggcgcuggccaucaugguggccgggcucagccuguggaugugcuccaacggcagccugcagugccgcaucugcaucuga

SEQ ID NO: 61968 - RNA, 1707 nt, Artificial Sequence
  derived and/or modified sequence opt1 from hemagglutinin__InfluenzaA__ABG20472
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaaggcccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcgaccacgaggccuccagcggcgucuccagcgcgugcccguaccagggccgcuccagcuucuuccggaacgugguguggcugaucaagaaggacaacgccuaccccaccaucaagcgcuccuacaacaacaccaaccaggaggaccugcugguccucugggggauccaccaccccaacgacgccgccgagcagacgcggcuguaccagaacccgaccaccuacaucagcgugggcaccuccacgcugaaccagcgccucgugcccaagaucgcgacccggagcaaggucaacgggcaguccggccgcauggaguucuucuggaccauccugaagcccaacgacgccaucaacuucgagagcaacgggaacuucaucgcccccgagaacgccuacaagaucgugaagaagggcgacagcaccaucaugaaguccgagcuggaguacggcaacugcaacacgaagugccagaccccgaucggggccaucaacagcuccaugcccuuccacaacauccacccccucaccaucggcgagugccccaaguacgucaagagcaaccggcuggugcuggcgaccgggcuccgcaacuccccgcagggcgagcggcgccggaagaagcgcggccuguucggggccaucgccggcuucaucgagggcggguggcaggggaugguggacggcugguacggcuaccaccacagcaacgagcagggguccggcuacgccgccgacaaggagagcacgcagaaggcgaucgacggggugaccaacaaggucaacuccaucaucgacaagaugaacacccaguucgaggccgugggccgggaguucaacaaccuggagcgccggaucgagaaccucaacaagaagauggaggacggguuccuggacguguggaccuacaacgccgagcugcucguccugauggagaacgagcgcacgcuggacuuccacgacagcaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccccaguacagcgaggaggcccgccugaagcgggaggagaucuccggcgugaagcuggagagcaucgggaccuaccagauccucuccaucuacagcaccgucgcguccagccuggcccuggccaucaugguggccggccucucccuguggaugugcagcaacgggagccugcagugccgcaucugcaucuga

SEQ ID NO: 61969 - RNA, 1707 nt, Artificial Sequence
  derived and/or modified sequence opt1 from hemagglutinin__InfluenzaA__ABG20478
auggagaagaucgugcuccuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgccugcccguaccagggccgcuccagcuucuuccggaacgugguguggcugaucaagaaggacaacgcguaccccaccaucaagcgcuccuacaacaacacgaaccaggaggaccuccugguccugugggggauccaccaccccaacgacgccgccgagcagacccggcucuaccagaacccgaccaccuacaucagcgugggcacguccacccugaaccagcgccuggugcccaagaucgccacccggagcaaggucaacgggcaguccggccgcauggaguucuucuggaccauccucaagcccaacgacgcgaucaacuucgagagcaacgggaacuucaucgcccccgagaacgccuacaagaucgugaagaagggcgacagcacgaucaugaaguccgagcuggaguacggcaacugcaacaccaagugccagaccccgaucggggccaucaacagcuccaugcccuuccacaacauccacccccugaccaucggcgagugccccaaguacgucaagagcaaccggcucgugcuggccacggggcugcgcaacuccccgcagggcgagcggcgccggaagaagcgcggccucuucggggcgaucgccggcuucaucgagggcggguggcaggggaugguggacggcugguacggcuaccaccacagcaacgagcagggguccggcuacgccgccgacaaggagagcacccagaaggccaucgacggggugaccaacaaggucaacuccaucaucgacaagaugaacacccaguucgaggcggugggccgggaguucaacaaccuggagcgccggaucgagaaccugaacaagaagauggaggacggguuccucgacguguggacguacaacgccgagcugcugguccucauggagaacgagcgcacccuggacuuccacgacagcaacgugaagaaccuguacgacaagguccggcuccagcugcgcgacaacgccaaggagcugggcaacggcugcuucgaguucuaccaccggugcgacaacgagugcauggaguccgugcgcaacgggaccuacgacuacccccaguacagcgaggaggcccgccucaagcgggaggagaucuccggcgugaagcuggagagcaucgggaccuaccagauccuguccaucuacagcacggucgccuccagccucgcgcuggccaucaugguggccggccugucccucuggaugugcagcaacgggagccugcagugccgcaucugcaucuga

SEQ ID NO: 61970 - RNA, 1701 nt, Artificial Sequence; identical to SEQ ID NO: 61791
  derived and/or modified sequence opt1 from hemagglutinin__InfluenzaA__ABG26758

SEQ ID NO: 61971 - RNA, 1701 nt, Artificial Sequence
  derived and/or modified sequence opt1 from hemagglutinin__InfluenzaA__ABG26769
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacgcuggaguucaacaacgaguccuucaacuggaccgggguggcccagaacggcaccagcuacgccugcaagcgccgguccgucaagagcuucuucucccgccucaacuggcugcacaagcuggaguacaaguaccccgcgcucaacgugaccaugcccaacaacgacaaguucgacaagcuguacaucuggggcgugcaccaccccagcacggacuccgaccagaccagccuguacgugcaggccuccgggcgggucaccgugagcaccaagcgcagccagcagacggugaucccgaacaucggguccggccccuggguccggggcgugagcucccgcaucagcaucuacuggaccaucgugaagcccggggacauccuccugaucaacuccaccggcaaccugaucgcgccccggggguacuucaagauccgcagcggcaaguccagcaucaugcgguccgacgccccgaucggcaacugcaacagcgagugcaucacccccaacggguccauccccaacgacaagcccuuccagaacgucaaccgcaucacguacggcgccugcccgcgguacgugaagcagaacacccucaagcuggccaccgggaugcgcaacgugcccgagaagcagacccggggcaucuucggggccaucgccggcuucaucgagaacggcugggaggggauggucgacggcugguacggguuccgccaccagaacagcgagggcacggggcaggccgccgaccugaaguccacccaggcggccaucaaccagaucaacggcaagcucaaccggcugaucgagaagaccaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacacgaucgaccugaccgacagcgagaugaacaagcuguucgagcggacccgcaagcagcuccgcgagaacgccgaggacauggggaacggcugcuuccggaucuaccacaagugcgacaacgcgugcaucggguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcugugcguggugcuccugggcuucaucaugugggccugccagaaggggaacauccggugcaacaucugcaucuga

SEQ ID NO: 61972 - RNA, 1701 nt, Artificial Sequence; identical to SEQ ID NO: 61919
  derived and/or modified sequence opt1 from hemagglutinin__InfluenzaA__ABG26780

SEQ ID NO: 61973 - RNA, 1701 nt, Artificial Sequence
  derived and/or modified sequence opt1 from hemagglutinin__InfluenzaA__ABG26791
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcucaaggagcagcugagcuccgucagcuccuucgagcgguucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgcgccaucuaccacaccgagaacgcguacgugagcguggucuccagccacuacucccggcgcuucaccccggagaucgccaagcggcccaaggugcgcgaccaggagggccggaucaacuacuacuggacccuccuggagcccggcgacacgaucaucuucgaggccaacgggaaccugaucgcccccugguacgccuucgcgcucagccgcggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcggagcacgaagcugcgcauggugaccgggcuccggaacaucccguccauccagagccgcggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggucaacagcgugaucgagaagaugaacacccaguucaccgccguggggaaggaguucaacaagcuggagcggcgcauggagaaccucaacaagaaggucgacgacggcuuccuggacaucuggaccuacaacgcggagcugcucgugcugcuggagaacgagcggacgcucgacuuccacgacagcaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacagcgaggaguccaagcucaagcgcgagaagaucgacggcgucaagcuggagagcaugggcguguaccagauccuggccaucuacagcaccguggccuccagccucguccugcuggugucccucggggccaucagcuucuggaugugcuccaacggcagccugcagugccggaucugcaucuga

SEQ ID NO: 61974 - RNA, 1701 nt, Artificial Sequence
  derived and/or modified sequence opt1 from hemagglutinin__InfluenzaA__ABG26802
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucagcaacugcuaccccuacgacgugccggacuacgcgucccugcggagccucgucgccuccagcggcacgcuggaguucaucaacgagggguucaacuggaccggcgugacccaguccgggggcagcuacgccugcaagcgcggguccgugaacagcuucuucucccggcugaacuggcucuacgagagcgaguccaaguaccccgcccugaacgucaccaugcccaacaacggcaaguucgacaagcuguacaucuggggcgugcaccaccccagcacggacaaggagcagaccaaccucuacgugcgcgcgagcgggcgggucaccguguccaccaagcgcagccagcagacggugaucccgaacaucggcccccggcccuggguccgcgggcuguccagccggaucuccaucuacuggaccaucgugaagcccggcgacauccugcucaucaacagcaccggcaaccugaucgccccgcgcggguacuucaagauccggaccggcaaguccagcaucaugcgcuccgacgcccccaucgggacgugcagcuccggcugcaucacccccaacgggagcauccccaacgacaagccguuccagaacgugaacaagaucaccuacggcgccugcccccgguacgucaagcagaacacccugaagcucgccacgggcaugcgcaacgugcccgagaagcagacccgggggaucuucggcgcgaucgccggguucaucgagaacggcugggaggggaugguggacggcugguacggcuuccgccaccagaacuccgaggggaccggccaggccgccgaccucaagagcacccaggccgcgaucgaccagaucaacgggaagcugaaccggcucaucgagaagacgaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgacaugaccgacuccgagaugaacaagcuguucgagaagacgcggaagcagcugcgcgagaacgccgaggacauggggaacggcugcuucaagaucuaccacaagugcgacaacgccugcaucggcagcauccgcaacgggaccuacgaccacgacgucuaccgggacgaggcgcugaacaaccgcuuccagaucaagggcguggagcucaaguccggguacaaggacuggauccuguggaucagcuucgccaucagcugcuuccugcucugcgucgugcugcugggcuucaucaugugggccugccagaagggcaacauccggugcaacaucugcaucuga

SEQ ID NO: 61975 - RNA, 1701 nt, Artificial Sequence; identical to SEQ ID NO: 61923
  derived and/or modified sequence opt1 from hemagglutinin__InfluenzaA__ABG26813

SEQ ID NO: 61976 - RNA, 1701 nt, Artificial Sequence
  derived and/or modified sequence opt1 from hemagglutinin__InfluenzaA__ABG26824
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggagcuacaucgccgagacccccaacagcgagaacgggaccugcuaccccggcuacuucgccgacuacgaggagcugcgcgagcagcuguccagcguguccagcuucgagcgguucgagaucuuccccaaggaguccagcuggccgaagcacaacgucaccaagggggugacggccuccugcagccacaagggcaaguccagcuucuaccgcaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccggaaggagaacgccuacgucagcgugguguccagccacuacaaccgccgguucacccccgagaucgcgaagcgcccgaagguccggaaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgagcauggacgagugcgacgccaagugccagacgccccagggcgccaucaacuccagccugccguuccagaacgugcaccccgugaccaucggcgagugccccaaguacguccgcuccaccaagcugcggauggugaccgggcuccgcaacauccccagcauccagucccggggccuguucggggccaucgccggcuucaucgagggcggcuggaccggcaugaucgacgggugguacggcuaccaccaccagaacgagcaggggagcggcuacgcggccgaccagaaguccacgcagaacgccaucaacgggaucaccaacaaggugaacagcaucaucgagaagaugaacacccaguucaccgccgucggcaaggaguucaacaagcuggagaagcgcauggagaaccucaacaagaagguggacgacggcuuccuggacaucuggacguacaacgccgagcugcucgugcugcuggagaacgagcggacccucgacuuccacgacuccaacgucaagaaccuguacgagaaggucaagagccagcugaagaacaacgcgaaggagaucgggaacggcugcuucgaguucuaccacaagugcaacaacgagugcauggaguccgugaagaacgggaccuacgacuacccgaaguacagcgaggagagcaagcucaaccgcgagaagaucgacggcgugaagcuggaguccauggggguguaccagauccuggccaucuacagcaccgucgccuccagccucgugcugcuggugucccucggcgccaucagcuucuggaugugcuccaacggcagccugcagugcaagaucugcaucuga

SEQ ID NO: 61977 - RNA, 1701 nt, Artificial Sequence; identical to SEQ ID NO: 61929
  derived and/or modified sequence opt1 from hemagglutinin__InfluenzaA__ABG26835

SEQ ID NO: 61978 - RNA, 1701 nt, Artificial Sequence
  derived and/or modified sequence opt1 from hemagglutinin__InfluenzaA__ABG26890
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuacccguacgacgugcccgacuacgcgagccuccggucccuggucgccagcuccggcacgcuggaguucaccaacgagaacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccacccgagcacggacuccgaccagaccagccuguacgugcgcgccuccgggaaggucaccgugagcaccaagcggucccagcagacggugauccccgacaucggcuaccgccccuggguccgggggcucagcagccgcaucuccaucuacuggaccaucgugaagcccggcgacauccugcugaucaacagcaccgggaaccucaucgccccgcggggcuacuucaagauccgcaacggcaaguccagcaucaugcgguccgacgcccccaucgggaacugcagcuccgagugcaucacccccaacggcagcauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagagcacccaggcggccaucgaccagaucaacggcaagcugaaccggcuggucgagaagaccaacgagaaguuccaccagaucgagaaggaguucuccgagguggaggggcgcauccaggaccucgagaaguacguggaggacaccaagaucgaccuguggagcuacaacgccgagcugcucgucgcccuggagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcgucgagcucaaguccggcuacaaggacuggauccuguggaucagcuucgccaucuccugcuuccugcucugcguggugcugcugggguucaucaugugggccugccagaagggcaacauccgcugcaacaucugcaucuga

SEQ ID NO: 61979 - RNA, 1701 nt, Artificial Sequence
  derived and/or modified sequence opt1 from hemagglutinin__InfluenzaA__ABG26901
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagccccaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuacccguacgacgugcccgacuacgcgagccuccggucccuggucgccagcuccggcacgcuggaguucaccaacgagaacuucaacuggaccgggguggcccaggacggcaagagcuacuccugcaagcgcgggagcgugaacuccuucuucagccggcucaacuggcugcacaaguccgaguacaaguaccccgcccugaacgucaccaugcccaacaacggcaaguucgacaagcucuacaucuggggcgugcaccacccgagcacggacuccgaccagaccagccuguacgugcgcgcguccgggaaggucaccgugagcaccaagcggagccagcagacggugauccccgacaucggcuaccgccccuggguccgggggcuguccagccgcaucuccaucuacuggaccaucgugaagcccggcgacauccuccugaucaacagcaccgggaaccugaucgccccgcggggcuacuucaagauccgcaacggcaaguccagcaucaugcgguccgacgcccccaucgggaacugcagcuccgagugcaucacccccaacggcagcauccccaacgacaagccguuccagaacgugaaccgcaucacguacggggccugcccccgguacgucaagcagaacacccucaagcuggccaccggcaugcgcaacgugcccgagaagcagacccgggggaucuucggcgcgaucgccggcuucaucgagaacgggugggagggcaugguggacgggugguacggcuuccgccaccagaacuccgaggggacgggccaggccgccgaccugaaguccacccaggccgcgaucgaccagaucaacggcaagcucaaccggcuggucgagaagaccaacgagaaguuccaccagaucgagaaggaguucuccgagguggaggggcgcauccaggaccuggagaaguacguggaggacaccaagaucgaccucuggagcuacaacgccgagcugcuggucgcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgccugcaucggcagcauccggaacgggaccuacgaccacgacguguaccgcgacgaggcgcugaacaaccgguuccagaucaagggcgucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 61980 - RNA, 1701 nt, Artificial Sequence
  derived and/or modified sequence opt1 from hemagglutinin__InfluenzaA__ABG26912
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaaggagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcaacggcaagagcuccaucaugcggagcgacgccccgaucuccaacugcaacagcgagugcaucacccccaacggguccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacagcgagggcacggggcaggccgccgaccugaaguccacccaggcggccaucgaccagaucaacggcaagcucaaccggcugaucgagaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcugugcgucgugcuccugggcuucaucaugugggccugccagaaggggaacauccgcugcaacaucugcaucuga

SEQ ID NO: 61981 - RNA, 1698 nt, Artificial Sequence
  derived and/or modified sequence opt1 from hemagglutinin__InfluenzaA__ABG26945
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcguccgggaaccugaucgccccgugguacgccuucgcccucagccggggcuucggcuccgggaucaucacgagcaacgcccccaugggcgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggcgccaucgccggguucaucgagggcggguggaccggcaugguggacgggugguacggcuaccaccaccagaacgagcagggcagcggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagagccagcugaagaacaacgcgaaggagaucgggaacggcugcuucgaguucuaccacaagugcaacaacgagugcauggaguccgugaagaacggcaccuacgacuaccccaaguacagcgaggaguccaagcucaaccgggagaagaucgacggggugaagcuggagagcaugggcgucuaccagauccuggccaucuacagcacgguggccuccagccucgugcugcuggucucccucggggccaucagcuucuggaugugcuccaacggcagccugcagugccgcaucugcaucuga

SEQ ID NO: 61982 - RNA, 1701 nt, Artificial Sequence
  derived and/or modified sequence opt1 from hemagglutinin__InfluenzaA__ABG26956
augaagaccaucaucgcccugagcuacauccucugccugguguucgcccagaagcugcccggcaacgacaaccgcaccgcgacgcucugccuggggcaccacgccgucccgaacggcacccuggugaagaccaucaccaacgaccagaucgaggugacgaacgccaccgagcucguccaguccagcuccaccgggcggaucugcgacagcccccaccagauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgucucccuccggagccugguggcguccagcggcacgcuggaguucaacaacgaguccuucaacuggaccgggguggcccagaacggcaccagcuccgccugcaagcgccggagcgacaaguccuucuucagcaagcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccuccgggcgcgugaccgucagcaccaagcggagccagcagaccgugaucccgaacaucggcucccgccccugggugcggggcgucagcucccgcaucagcaucuacuggacgaucgugaagcccggggacauccuccugaucaacuccaccggcaaccugaucgcgccccggggguacuucaagauccgcagcggcaaguccagcaucaugcgguccgacgccccgaucggcaagugcaacagcgagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacagcgagggcaccgggcaggccgccgaccugaaguccacgcaggcggccaucaaccagaucaacggcaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagagcggcuacaaggacugggugcuguggaucuccuucgccaucagcugcuuccugcugugcaucguccuccugggcuucaucaugugggccugccagaaggggaacauccggugcaacaucugcaucuga

SEQ ID NO: 61983 - RNA, 1698 nt, Artificial Sequence
  derived and/or modified sequence opt1 from hemagglutinin__InfluenzaA__ABG37120
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggggagagcuccuucuaccgcaaccugcuguggcucaccggcaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 61984 - RNA, 1701 nt, Artificial Sequence
  derived and/or modified sequence opt1 from hemagglutinin__InfluenzaA__ABG37131
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacggcccccaccagauccucgacgggaagaacugcacccugaucgacgcccugcucggcgacccccacugcgacggcuuccagaacaaggagugggaccuguucguggagcggagcaaggccuacuccaacugcuaccccuacgacgugccggacuacgcgagccugcgcucccucgucgccagcuccgggacgcuggaguucaccaacgagagcuucaacuggaccggcguggcccagaacgggaccuccuacgccugcaagcggggcagcgugaaguccuucuucagccgccugaacuggcuccacaagcuggaguacaaguaccccgcgcugaacgucacgaugcccaacaacgacaaguucgacaagcucuacaucuggggcgugcaccaccccuccaccgacagcgaccagaccucccuguacgugcagagcagcgggcgggucaccguguccacgaagcgcagccagcagaccgugaccccgaacaucggcucccggcccuggguccgcgggaucagcucccggaucagcaucuacuggaccaucgugaagcccggcgacauccugcucaucaacuccacggggaaccugaucgcgccccgcggcuacuucaagauccggcgcggcaagagcuccaucaugcggagcgacgccccgaucgacaacugcaacuccgagugcaucacccccaacgggagcauccccaacgacaagcccuuccagaacgugaaccgcaucaccuacggcgccugcccgcgguacgucaagcagaacacccugaagcucgccacggggaugcgcaacgugcccgagaagcagacccggggcaucuucggggccaucgccggcuucaucgagaacggcugggaggggaugguggacggcugguacggguuccgccaccagaacuccgagggcaccgggcaggccgccgaccucaagagcacccaggccgcgaucaaccagaucaacggcaagcugaaccggcugaucgagaagacgaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucaccgacuccgagaugaacaagcuguucgagcggacgcgcaagcagcugcgcgagaacgccgaggacauggggaacggcugcuucaagaucuaccacaagugcgacaacgccugcaucgggagcauccggaacggcaccuacgaccacgacgucuaccgcgacgaggcgcucaacaaccgguuccagaucaaggggguggagcugaaguccggcuacaaggacuggauccuguggaucagcuucgccaucagcugcuuccuccugugcgucgugcugcucggcuucaucaugugggccugccagaaggggaacauccgcugcaacaucugcaucuga

SEQ ID NO: 61985 - RNA, 1701 nt, Artificial Sequence; identical to SEQ ID NO: 61791
  derived and/or modified sequence opt1 from hemagglutinin__InfluenzaA__ABG37142

SEQ ID NO: 61986 - RNA, 1701 nt, Artificial Sequence
  derived and/or modified sequence opt1 from hemagglutinin__InfluenzaA__ABG37164
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacgacuuccagaacaaggagugggaccuguucguggagcgcagcaaggccuacuccaacugcuaccccuacgacgugccggacuacgcgagccuccggucccuggucgccagcuccggcacgcuggaguucaccaaggagggcuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccggggcaucagcucccgcaucagcaucuacuggaccaucgugaagcccggggacauccuccugaucaacuccaccggcaaccugaucgcgccccggggguacuucaagauccgcaacggcaagagcuccaucaugcggagcgacgccccgaucggcaacugcaacuccgagugcaucacccccaacgggagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccugaaguccacccaggcggccaucgaccagaucaacggcaagcucaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcaacaucugcaucuga

SEQ ID NO: 61987 - RNA, 1701 nt, Artificial Sequence
  derived and/or modified sequence opt1 from hemagglutinin__InfluenzaA__ABG37175
augaagaccaucaucgcccugagcuacauccucugccagguguucgccaagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaccaacgagggguucaacuggaccggcguggcccaggacgggaaguccuacuccugcaagcgcggcagcgugaacuccuucuucagccggcugaacuggcuccacaagcuggaguacaaguaccccgcccugaacgucaccaugcccaacaacgacaaguucgacaagcucuacaucuggggcgugcaccaccccuccacggacagcgaccagaccucccuguacgugcaggcgagcgggcgcgucaccgugagcaccaagcggucccagcagacggugaucccgaacaucggcagccgccccuggguccgggggaucuccagccgcaucuccaucuacuggaccaucgugaagcccggcgacauccugcucaucaacagcaccgggaaccugaucgcgccccggggcuacuucaagauccgcaacggcaaguccagcaucaugcgguccgacgccccgaucgacaacugcaacagcgagugcaucacccccaacggguccauccccaacgacaagcccuuccagaacgugaaccgcaucacguacggcgccugcccgcgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacagcgagggcacggggcaggccgccgaccugaaguccacccaggccgcgaucgaccagaucaacggcaagcugaaccggcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggacccgcaagcagcugcgcgagaacgccgaggacauggggaacggcugcuucaagaucuaccacaagugcgacaacgccugcaucggguccauccggaacggcaccuacgaccacgacgucuaccgcgacgaggcgcucaacaaccgguuccagaucaaggggguggagcucaagagcggcuacaaggacuggauccuguggaucuccuucgccaucagcugcuuccugcugugcgucgugcugcucggcuucaucaugugggccugccagaaggggaacauccgcugcaacaucugcaucuga

SEQ ID NO: 61988 - RNA, 1701 nt, Artificial Sequence
  derived and/or modified sequence opt1 from hemagglutinin__InfluenzaA__ABG37186
augaagaccaucaucgcccugagcuacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaccaacgagggguucaacuggaccggcguggcccaggacgggaaguccuacgccugcaagcgcggcuccgugaacagcuucuucucccggcugaacuggcuccacaagcuggaguacaaguaccccgcgcugaacgucaccaugcccaacaacgacaaguucgacaagcucuacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccugcucaucuccagcaccgggaaccugaucgcgccccggggcuacuucaagauccgcaacggcaaguccagcaucaugcgguccgacgccccgaucgacaacugcaacagcgagugcaucacccccaacggguccauccccaacgacaagcccuuccagaacgugaaccgcgucacguacggcgccugcccgcgguacgugaagcagaacacccugaagcucgccaccgggaugcgcaacgugcccgagaagcagacccggggcaucuucggggccaucgccggcuucaucgagaacggcugggaggggauggucgacggcugguacggguuccgccaccagaacagcgagggcacggggcaggccgccgaccugaaguccacccaggcggccaucgaccagaucaacggcaagcugaaccggcucaucgagaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagcggacccgcaagcagcugcgcgagaacgccgaggacauggggaacggcugcuucaagaucuaccacaagugcgacaacgcgugcaucggguccauccggaacggcaccuacgaccacgacguguacaaggacgaggcccucaacaaccgcuuccagaucaagggggucgugcucaagagcggcuacaaggacuggauccuguggaucuccuucgccaucagcugcuuccugcugugcgugguccugcucggcuucaucaugugggccugccagaaggggaacauccggugcaacaucugcaucuga

SEQ ID NO: 61989 - RNA, 1701 nt, Artificial Sequence
  derived and/or modified sequence opt1 from hemagglutinin__InfluenzaA__ABG37197
augaagaccaucaucgcccugagcuacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaccaacgagggguucaacuggaacggcguggcccaggacgggaaguccuacgccugcaagcgcggcuccgucaagagcuucuucucccggcugaacuggcuccacaagcuggaguacaaguaccccgcgcugaacgugaccaugcccaacaacgacaaguucgacaagcucuacaucuggggcgugcaccaccccagcaccgacuccgaccagacgagccuguacgugcaggccuccgggcgcgucaccgugagcaccaagcggagccagcagaccgugaucccgaacaucggcucccgccccuggguccgggggaucagcucccgcaucagcaucuacuggacgaucgugaagcccggcgacauccugcucaucaacuccaccgggaaccugaucgcgccccggggcuacuucaagauccgcaacggcaagagcuccaucaugcggagcgacgccccgaucgacaacugcaacuccgagugcaucacccccaacgggagcauccccaacgacaagcccuuccagaacgugaaccgcaucaccuacggcgccugcccgcgguacgucaagcagaacacgcugaagcucgccaccgggaugcgcaacgugcccgagaagcagacccggggcaucuucggggccaucgccggcuucaucgagaacggcugggaggggaugguggacggcugguacggguuccgccaccagaacuccgagggcaccgggcaggccgccgaccucaagagcacgcaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucacggacuccgagaugaacaagcuguucgagcggacccgcaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcgucgugcugcucggcuucaucaugugggccugccagaaggggaacauccgcugcaacaucugcaucuga

SEQ ID NO: 61990 - RNA, 1701 nt, Artificial Sequence
  derived and/or modified sequence opt1 from hemagglutinin__InfluenzaA__ABG37208
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucagcaacugcuaccccuacgacgugccggacuacgcgucccugcggagccucgucgccuccagcggcacgcuggaguucaucaacgagggguucaacuggaccggcgugacccaguccgggggcagcuacgccugcaagcgcggguccgugaacagcuucuucucccggcugaacuggcucuacaagagcgaguccaaguaccccgcccugaacgucaccaugcccaacaacggcaaguucgacaagcuguacaucuggggcgugcaccaccccagcacggacaaggagcagaccaaccucuacgugcgcgcgagcgggcgggucaccguguccaccaagcgcagccagcagacggugaucccgaacaucggcccccggcccuggguccgcgggcuguccagccggaucuccaucuacuggaccaucgugaagcccggcgacauccugcucaucaacagcaccggcaaccugaucgccccgcgcggguacuucaagauccggaccggcaaguccagcaucaugcgcuccgacgcccccaucgggacgugcagcuccggcugcaucacccccaacgggagcauccccaacgacaagccguuccagaacgugaacaagaucaccuacggcgccugcccccgguacgucaagcagaacacccugaagcucgccacgggcaugcgcaacgugcccgagaagcagacccgggggaucuucggcgcgaucgccggguucaucgagaacggcugggaggggaugguggacggcugguacggcuuccgccaccagaacuccgaggggaccggccaggccgccgaccucaagagcacccaggccgcgaucgaccagaucaacgggaagcugaaccggcucaucgagaagacgaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgacaugaccgacuccgagaugaacaagcuguucgagaagacgcggaagcagcugcgcgagaacgccgaggacauggggaacggcugcuucaagaucuaccacaagugcgacaacgccugcaucggcagcauccgcaacgggaccuacgaccacgacgucuaccgggacgaggcgcugaacaaccgcuuccagaucaagggcguggagcucaaguccggguacaaggacuggauccuguggaucagcuucgccaucagcugcuuccugcucugcgucgugcugcugggcuucaucaugugggccugccagaagggcaacauccggugcaacaucugcaucuga

SEQ ID NO: 61991 - RNA, 1701 nt, Artificial Sequence
  derived and/or modified sequence opt1 from hemagglutinin__InfluenzaA__ABG37230
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcaccagagcaaguacaaguaccccgagcugaacgucaccaugcccaacaacggcaaguucgacaagcucuacaucuggggcgugcaccaccccuccaccgacagcgaccagacgucccuguacgcgcgcgccagcgggcgggugaccgucagcaccaagcgcucccagcagaccgugaucccgaacaucggcuuccggcccugggugcgcgggcugagcucccggaucagcaucuacuggacgaucgucaagcccggcgacauccuccugaucaacuccaccgggaaccugaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggcuucaucgagaacgggugggagggcaugguggacgggugguacggcuuccggcaccagaacagcgaggggaccggccaggccgccgaccugaaguccacgcaggcggccaucgaccagaucaacggcaagcucaaccgccugaucgagaagaccaacgagaaguuccaccagaucgagaaggaguucagcgagguggaggggcggauccaggaccuggagaaguacgucgaggacaccaagaucgaccucugguccuacaacgccggccugcugguggcccucgagaaccagcacaccaucgaccugacggacagcgagaugaacaagcuguucgagcgcacccgcaagcagcuccgggagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggcgucgagcugaaguccggguacaaggacuggauccucuggaucuccuucgccaucagcugcuuccugcugugcgugguccuccugggcuucaucaugugggccugccagaaggggaacauccggugcaacaucugcaucuga

SEQ ID NO: 61992 - RNA, 1701 nt, Artificial Sequence
  derived and/or modified sequence opt1 from hemagglutinin__InfluenzaA__ABG37241
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggagccuggucgccuccagcggcacgcuggaguucaccaacgagaacuucaacuggaccgggguggcccaggacggcaaguccuacgccugcaagcgcgggagcgugaacuccuucuucagccggcucaacuggcugcacaagcuggaguacaaguaccccgcgcucaacgucaccaugcccaacaacggcaaguucgacaagcuguacaucuggggcgugcaccacccguccacggacagcgaccagaccucccuguacgugcgcgccagcgggaaggucaccguguccaccaagcggagccagcagacggugauccccgacaucggcuaccgccccuggguccgggggcucagcucccgcaucagcaucuacuggaccaucgugaagcccggcgacauccugcugaucaacuccaccgggaaccucaucgccccgcggggcuacuucaagauccgcaacggcaagagcuccaucaugcggagcgacgcccccaucgggaacugcuccagcgagugcaucacccccaacggcuccauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacagcgaggggacgggccaggccgccgaccucaaguccacccaggcggccaucgaccagaucaacggcaagcugaaccggcuggucgagaagaccaacgagaaguuccaccagaucgagaaggaguucagcgagguggaggggcgcauccaggaccucgagaaguacguggaggacaccaagaucgaccugugguccuacaacgccgagcugcucgucgcccuggagaaccagcacacgaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcgucgagcucaagagcggcuacaaggacuggauccuguggaucuccuucgccaucagcugcuuccugcucugcguggugcugcugggguucaucaugugggccugccagaagggcaacauccgcugcaacaucugcaucuga

SEQ ID NO: 61993 - RNA, 1701 nt, Artificial Sequence
  derived and/or modified sequence opt1 from hemagglutinin__InfluenzaA__ABG37252
augaagaccaucaucgcccugagcuacauccucugccugguguucgcccagaagcugaccggcaacgacaacuccacggcgacccucugccuggggcaccacgccguccccaacggcacccuggugaagaccaucacgaacgaccagaucgaggugaccaacgccaccgagcucguccagagcuccccgaccgggcgcaucugcgacagcccccaccggauccuggacggcaagaacugcacgcugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacccuggaguucaccaacgagaacuucaacuggaccgggguggcccaggacggcaaguccuacgccugcaagcgcgggagcgugaacuccuucuucagccggcucaacuggcugcacaagcuggaguacaaguaccccgcgcucaacgucacgaugcccaacaacggcaaguucgacaagcuguacaucuggggcgugcaccaccccuccaccgacagcgaccagaccucccuguacgugcgcgccagcgggaaggucaccguguccacgaagcggagccagcagaccgugaucccggacaucggcuaccgccccuggguccgggggcucagcucccgcaucagcaucuacuggaccaucgugaagcccggcgacauccugcugaucaacuccaccgggaaccucaucgcgccccggggcuacuucaagauccgcaacggcaagagcuccaucaugcggagcgacgccccgaucgggaacugcuccagcgagugcaucacgcccaacggcuccauccccaacgacaagcccuuccagaacgugaaccgcaucaccuacggggccugcccgcgguacgucaagcagaacacccugaagcuggccaccggcaugcgcaacgugcccgagaagcagacgcgggggaucuucggcgccaucgccggcuucaucgagaacgggugggagggcaugguggacgggugguacggcuuccgccaccagaacagcgaggggaccggccaggccgccgaccucaaguccacccaggcggccaucgaccagaucaacggcaagcugaaccggcuggucgagaagaccaacgagaaguuccaccagaucgagaaggaguucagcgagguggaggggcgcauccaggaccucgagaaguacguggaggacacgaagaucgaccugugguccuacaacgccgagcugcucgucgcccuggagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcucaagagcggcuacaaggacuggauccuguggaucuccuucgccaucagcugcuuccugcucugcguggugcugcugggguucaucaugugggccugccagaagggcaacauccgcugcaacaucugcaucuga

SEQ ID NO: 61994 - RNA, 1701 nt, Artificial Sequence
  derived and/or modified sequence opt1 from hemagglutinin__InfluenzaA__ABG37263
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaaggagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcaacggcaagagcuccaucaugcggagcgacgccccgaucgggaacugcaacuccgagugcaucacccccaacggcagcauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagagcacccaggcggccaucgaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacacgugcaucggcagcauccggaacgggaccuacgaccacgacgucuaccgcgacgaggcgcugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61995 - RNA, 1701 nt, Artificial Sequence
  derived and/or modified sequence opt1 from hemagglutinin__InfluenzaA__ABG37274
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggagccuggucgccuccagcggcacgcuggaguucaccaacgagaacuucaacuggaccgggguggcccaggacggcaaguccuacgccugcaagcgcgggagcgugaacuccuucuucagccggcucaacuggcugcacaagcuggaguacaaguaccccgcgcucaacgucaccaugcccaacaacggcaaguucgacaagcuguacaucuggggcgugcaccacccguccacggacagcgaccagaucucccuguacgugcgcgccagcgggaaggucaccguguccaccaagcggagccagcagaccgugauccccgacaucggcuaccgccccuggguccgggggcucagcucccgcaucagcaucuacuggacgaucgugaagcccggcgacauccugcugaucuccagcaccgggaaccucaucgccccgcggggcuacuucaagauccgcaacggcaaguccagcaucaugcgguccgacgcccccaucgggaacugcagcuccgagugcaucacccccaacggcagcauccccaacgacaagccguuccagaacgugaaccgcaucaccuacggggccugcccccgguacgucaagcagaacacgcugaagcuggcgaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcuggucgagaagaccaacgagaaguuccaccagaucgagaaggaguucuccgagguggaggggcgcauccaggaccucgagaaguacguggaggacaccaagaucgaccuguggagcuacaacgccgagcugcucgucgcccuggagaaccagcacaccaucgaccugacggacuccgagaugaacaagcuguucgagcggacccgcaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcgucgagcucaaguccggcuacaaggacuggauccuguggaucagcuucgccaucuccugcuuccugcucugcguggugcugcugggguucaucaugugggccugccagaagggcaacauccgcugcaacaucugcaucuga

SEQ ID NO: 61996 - RNA, 1701 nt, Artificial Sequence
  derived and/or modified sequence opt1 from hemagglutinin__InfluenzaA__ABG37285
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggagccuggucgccuccagcggcacgcuggaguucaccaacgagaacuucaacuggaccgggguggcccaggacggcaaguccuacgccugcaagcgcgggagcgugaacuccuucuucagccggcucaacuggcugcacaagcuggacuacaaguaccccgcgcucaacgucaccaugcccaacaacggcaaguucgacaagcuguacaucuggggcgugcaccacccguccacggacagcgaccagaccucccuguacgugcgcgccagcgggaaggucaccguguccaccaagcggagccagcagacggugauccccgacaucggcuaccgccccuggguccgggggcucagcucccgcaucagcaucuacuggaccaucgugaagcccggcgacauccugcugaucaacuccaccgggaaccucaucgccccgcggggcuacuucaagauccgcaacggcaagagcuccaucaugcggagcgacgcccccaucgggaacugcuccagcgagugcaucacccccaacggcuccauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacagcgaggggacgggccaggccgccgaccucaaguccacccaggcggccaucgaccagaucaacggcaagcugaaccggcuggucgagaagaccaacgagaaguuccaccagaucgagaaggaguucagcgagguggaggggcgcauccaggaccucgagaaguacguggaggacaccaagaucgaccugugguccuacaacgccgagcugcucgucgcccuggagaaccagcacacgaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcgucgagcucaagagcggcuacaaggacuggauccuguggaucuccuucgccaucagcugcuuccugcucugcuucgugcugcugggguucaucaugugggccugccagaagggcaacauccgcugcaacaucugcaucuga

SEQ ID NO: 61997 - RNA, 1701 nt, Artificial Sequence
  derived and/or modified sequence opt1 from hemagglutinin__InfluenzaA__ABG37296
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaaggagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcaacggcaagagcuccaucaugcggagcgacgccccgaucgggaacugcaacuccgagugcaucacccccaacggcagcauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagagcacccaggcggccaucgaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggaccuacgaccacgacgucuaccgcgacgaggcccugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 61998 - RNA, 1701 nt, Artificial Sequence; identical to SEQ ID NO: 61992
  derived and/or modified sequence opt1 from hemagglutinin__InfluenzaA__ABG37307

SEQ ID NO: 61999 - RNA, 1701 nt, Artificial Sequence; identical to SEQ ID NO: 61997
  derived and/or modified sequence opt1 from hemagglutinin__InfluenzaA__ABG37318

SEQ ID NO: 62000 - RNA, 1701 nt, Artificial Sequence
  derived and/or modified sequence opt1 from hemagglutinin__InfluenzaA__ABG37329
augaagaccaucaucgcccugagcuacauccucugccugguguucgcccagaagcugcccgagaacgacaacuccaccgcgacgcucugccugggccaccacgccgucccgaacgggacccuggugaagaccaucaccaacgaccagaucgaggugacgaacgccaccgagcucguccagagcucccccaccggccgcaucugcgacagcccccaccggauccuggacgggaagaacugcacccugaucgacgcccuccugggcgacccccacugcgacggguuccagaacaaggagugggaccuguucguggagcgcuccaaggccuacagcaacugcuacccguacgacgugcccgacuacgcgucccuccggagccuggucgccuccagcggcacgcuggaguucaccaacgagaacuucaacuggaccggcguggcccaggacgggaaguccuacgccugcaagcgcggcagcgugaacuccuucuucagccggcucaacuggcugcacaagcuggaguacaaguaccccgcgcucaacgucaccaugcccaacaacgggaaguucgacaagcuguacaucuggggcgugcaccacccguccacggacagcgaccagaccucccuguacgugcgcgccagcgggaaggucaccguguccaccaagcggagccagcagacggugauccccgacaucggcuaccgccccuggguccggggccucagcucccgcaucagcaucuacuggaccaucgugaagcccggggacauccugcugaucaacuccaccggcaaccucaucgccccgcggggguacuucaagauccgcaacggcaagagcuccaucaugcggagcgacgcccccaucggcaacugcuccagcgagugcaucacccccaacggguccauccccaacgacaagccguuccagaacgugaaccgcaucacguacggcgccugcccccgguacgucaagcagaacacccugaagcuggcgaccgggaugcgcaacgugcccgagaagcagacccggggcaucuucggggccaucgccggcuucaucgagaacggcugggaggggaugguggacggcugguacggguuccgccaccagaacagcgagggcacggggcaggccgccgaccucaaguccacccaggcggccaucgaccagaucaacggcaagcugaaccggcuggucgagaagaccaacgagaaguuccaccagaucgagaaggaguucagcgagguggagggccgcauccaggaccucgagaaguacguggaggacaccaagaucgaccugugguccuacaacgccgagcugcucgucgcccuggagaaccagcacacgaucgaccugaccgacagcgagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacguguaccgcgacgaggcccugaacaaccgguuccagaucaagggggucgagcucaagagcggcuacaaggacuggauccuguggaucuccuucgccaucagcugcuuccugcucugcguggugcugcugggcuucaucaugugggccugccagaaggggaacauccgcugcaacaucugcaucuga

SEQ ID NO: 62001 - RNA, 1701 nt, Artificial Sequence
  derived and/or modified sequence opt1 from hemagglutinin__InfluenzaA__ABG37340
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuuccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuacccguacgacgugcccgacuacgcgagccuccggucccuggucgccagcuccggcacgcuggaguucaccaacgagaacuucaacuggaccgggguggcccaggacggcaagagcuacuccugcaagcgcgggagcgugaacuccuucuucagccggcucaacuggcugcacaagcuggaguacaaguaccccgcccucaacgucaccaugcccaacaacggcaaguucgacaagcuguacaucuggggcgugcaccacccguccacggacagcgaccagaccucccuguacgugcgcgcgagcgggaaggucaccguguccaccaagcggagccagcagacggugauccccgacaucggcuaccgccccuggguccgggggcucagcucccgcaucagcaucuacuggaccaucgugaagcccggcgacauccugcugaucaacuccaccgggaaccucaucgccccgcggggcuacuucaagauccgcaacggcaagagcuccaucaugcggagcgacgcccccaucgggaacugcuccagcgagugcaucacccccaacggcuccauccccaacgacaagccguuccagaacgugaaccgcaucacguacggggccugcccccgguacgucaagcagaacacccugaagcuggccaccggcaugcgcaacgugcccgagaagcagacccgggggaucuucggcgcgaucgccggcuucaucgagaacgggugggagggcaugguggacgggugguacggcuuccgccaccagaacagcgaggggacgggccaggccgccgaccucaaguccacccaggccgcgaucgaccagaucaacggcaagcugaaccggcuggucgagaagaccaacgagaaguuccaccagaucgagaaggaguucagcgagguggaggggcgcauccaggaccucgagaaguacguggaggacaccaagaucgaccugugguccuacaacgccgagcugcucgucgcccuggagaaccagcacacgaucgaccugaccgacagcgagaugaacaagcuguucgagcggacccgcaagcagcuccgcgagaacgccgaggacaugggcaacgggugcuucaagaucuaccacaagugcgacaacgccugcaucggcuccauccggaacgggaccuacgaccacgacguguaccgcgacgaggcgcugaacaaccgguuccagaucaagggcgucgagcucaagagcggcuacaaggacuggauccuguggaucuccuucgccaucagcugcuuccugcucugcguggugcugcugggguucaucaugugggccugccagaagggcaacauccgcugcaacaucugcaucuga

SEQ ID NO: 62002 - RNA, 1701 nt, Artificial Sequence
  derived and/or modified sequence opt1 from hemagglutinin__InfluenzaA__ABG37351
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucgacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 62003 - RNA, 1698 nt, Artificial Sequence
  derived and/or modified sequence opt1 from hemagglutinin__InfluenzaA__ABG37362
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 62004 - RNA, 1698 nt, Artificial Sequence; identical to SEQ ID NO: 61808
  derived and/or modified sequence opt1 from hemagglutinin__InfluenzaA__ABG37384

SEQ ID NO: 62005 - RNA, 1698 nt, Artificial Sequence; identical to SEQ ID NO: 61878
  derived and/or modified sequence opt1 from hemagglutinin__InfluenzaA__ABG37395

SEQ ID NO: 62006 - RNA, 1701 nt, Artificial Sequence; identical to SEQ ID NO: 61785
  derived and/or modified sequence opt1 from hemagglutinin__InfluenzaA__ABG37406

SEQ ID NO: 62007 - RNA, 1701 nt, Artificial Sequence
  derived and/or modified sequence opt1 from hemagglutinin__InfluenzaA__ABG37428
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaagucccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcucaagagcggcuacaaggacugggugcuguggaucagcuucgccaucuccugcuuccugcugugcaucguccuccugggcuucaucaugugggccugccagaaggggaacauccggugcaacaucugcaucuga

SEQ ID NO: 62008 - RNA, 1701 nt, Artificial Sequence; identical to SEQ ID NO: 61570
  derived and/or modified sequence opt1 from hemagglutinin__InfluenzaA__ABG37439

SEQ ID NO: 62009 - RNA, 1701 nt, Artificial Sequence; identical to SEQ ID NO: 61648
  derived and/or modified sequence opt1 from hemagglutinin__InfluenzaA__ABG37461

SEQ ID NO: 62010 - RNA, 1701 nt, Artificial Sequence
  derived and/or modified sequence opt1 from hemagglutinin__InfluenzaA__ABG37472
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccaggugcuggacggcgagaacugcacccugaucgacgcccuccugggggacccccacugcgacggcuuccagaacaaggagugggaccuguucguggagcggagcaaggccuacuccaacugcuaccccuacgacgucccggacuacgugagccuccgcucccugguggcgagcuccggcacgcuggaguucaacaacgagagcuucaacuggaccggggucgcccagaacggcaccuccagcgccugcaagcggcgcuccgacaagagcuucuucucccggcucaacuggcugcaccagcugaaguacaaguaccccgcccucaacgugaccaugcccaacaacgagaaguucgacaagcuguacaucuggggcgugcaccaccccgggacggacagcgaccagaucucccuguacgcgcaggccagcgggcgcgucaccgugagcaccaagcggucccagcagaccgugaucccgaacaucggcagccgccccuggguccggggcguguccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaaccgcaucaccuacggcccgugcccccgguacgugaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacgucuaccgggacgaggcgcugaacaaccgcuuccagaucaaggggguggagcugaaguccggcuacaaggacuggauccucuggaucagcuucgccaucagcugcuuccugcugugcaucguccuccugggcuucaucaugugggccugccagaaggggaacauccggugcaacaucugcaucuga

SEQ ID NO: 62011 - RNA, 1701 nt, Artificial Sequence; identical to SEQ ID NO: 61570
  derived and/or modified sequence opt1 from hemagglutinin__InfluenzaA__ABG37483

SEQ ID NO: 62012 - RNA, 1701 nt, Artificial Sequence; identical to SEQ ID NO: 61648
  derived and/or modified sequence opt1 from hemagglutinin__InfluenzaA__ABG37494

SEQ ID NO: 62013 - RNA, 1701 nt, Artificial Sequence
  derived and/or modified sequence opt1 from hemagglutinin__InfluenzaA__ABG37505
augaagaccaucaucgcccugagcuacauccucugccugguguucgcccagaagcugcccggcaacgacaacuccauggcgacccucugccuggggcaccacgccgucccgaacggcacgcuggugaagaccaucaccaacgaccagaucgaggugaccaacgccacggagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcgguccaaggccuacuccaacugcuaccccuacgacgugccggacuacgucagccuccgcucccugguggcgagcuccggcacccuggaguucaacaacgagagcuucaacuggacggggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggaccgacagcgaccagaucucccuguacgcgcaggccagcgggcgcgugacggucagcaccaagcggucccagcagaccgugaucccgaacaucggcagccgccccugggugcggggcgucuccagccgcaucuccaucuacuggaccaucgugaagcccggggacauccuccugaucaacagcacgggcaaccugaucgcgccccggggguacuucaagauccgcuccggcaagagcuccaucaugcggagcgacgccccgaucgacaagugcaacuccgagugcaucacccccaacggcagcauccccaacgacaagcccuuccagaacgugaaccgcaucaccuacgggcucugcccgcgguacgucaagcagaacacccugaagcuggccacgggcaugcgcaacgugcccgagaagcagacccgggggaucuucggcgccaucgccggguucaucgagaacggcugggagggcaugauggacgggugguacggcuuccgccaccagaacuccgaggggaccggccaggccgccgaccucaagagcacccaggccgcgaucaaccagaucaacgggaagcugaaccggcugaucgagaagacgaacgagaaguuccaccagaucgagaaggaguucuccgagguggagggccgcauccaggaccucgagaaguacgucgaggacaccaagaucgaccuguggagcuacaacgccgagcugcucguggcccuggagaaccagcacaccaucgaccugaccgacuccgagaugaacaagcuguucgagcggacgaagaagcagcuccgcgagaacgccgaggacaugggcaacgggugcuucaagaucuaccacaagugcgacaacgccugcaucggcagcauccgcaacgggaccuacgaccacgacguguaccgggacgaggcgcugaacaaccgcuuccagaucaagggcgucgagcucaaguccggguacaaggacuggauccuguggaucagcuucgccaucagcugcuuccugcucugcaucgugcugcugggcuucaucaugugggccugccagaagggcaacauccggugcaacaucugcaucuga

SEQ ID NO: 62014 - RNA, 1701 nt, Artificial Sequence; identical to SEQ ID NO: 61524
  derived and/or modified sequence opt1 from hemagglutinin__InfluenzaA__ABG37516

SEQ ID NO: 62015 - RNA, 1701 nt, Artificial Sequence; identical to SEQ ID NO: 61524
  derived and/or modified sequence opt1 from hemagglutinin__InfluenzaA__ABG37527

SEQ ID NO: 62016 - RNA, 1701 nt, Artificial Sequence; identical to SEQ ID NO: 61524
  derived and/or modified sequence opt1 from hemagglutinin__InfluenzaA__ABG37538

SEQ ID NO: 62017 - RNA, 1701 nt, Artificial Sequence; identical to SEQ ID NO: 61524
  derived and/or modified sequence opt1 from hemagglutinin__InfluenzaA__ABG37549

SEQ ID NO: 62018 - RNA, 1701 nt, Artificial Sequence; identical to SEQ ID NO: 61524
  derived and/or modified sequence opt1 from hemagglutinin__InfluenzaA__ABG37560

SEQ ID NO: 62019 - RNA, 1701 nt, Artificial Sequence; identical to SEQ ID NO: 61524
  derived and/or modified sequence opt1 from hemagglutinin__InfluenzaA__ABG37571

SEQ ID NO: 62020 - RNA, 1701 nt, Artificial Sequence
  derived and/or modified sequence opt1 from hemagglutinin__InfluenzaA__ABG37582
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggaccacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 62021 - RNA, 1701 nt, Artificial Sequence; identical to SEQ ID NO: 61524
  derived and/or modified sequence opt1 from hemagglutinin__InfluenzaA__ABG37604

SEQ ID NO: 62022 - RNA, 1701 nt, Artificial Sequence; identical to SEQ ID NO: 61524
  derived and/or modified sequence opt1 from hemagglutinin__InfluenzaA__ABG37615

SEQ ID NO: 62023 - RNA, 1698 nt, Artificial Sequence; identical to SEQ ID NO: 61750
  derived and/or modified sequence opt1 from hemagglutinin__InfluenzaA__ABG47807

SEQ ID NO: 62024 - RNA, 1698 nt, Artificial Sequence; identical to SEQ ID NO: 61749
  derived and/or modified sequence opt1 from hemagglutinin__InfluenzaA__ABG47818

SEQ ID NO: 62025 - RNA, 1701 nt, Artificial Sequence
  derived and/or modified sequence opt1 from hemagglutinin__InfluenzaA__ABG47829
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucaccaagcgccccaaggugcggaaccaggagggccgcaucaacuacuacuggacgcuccuggagcccggcgacaccaucaucuucgaggccaacgggaaccugaucgcccccugguacgccuucgcccucagccggggcuucggguccggcaucaucaccagcaacgcguccaugggcgagugcgacgccaagugccagaccccgcagggggccaucaacagcucccugcccuuccagaacgugcaccccgucacgaucggcgagugccccaaguacgugcgcagcaccaagcugcggauggugaccgggcuccgcaacaucccguccauccagagccggggccuguucggggccaucgccggcuucaucgagggcggguggaccggcaugaucgacgggugguacggcuaccaccaccagaacgagcagggguccggcuacgcggccgaccagaaguccacgcagaacgccaucgacggcaucaccaacaaggucaacagcgugaucgagaagaugaacacccaguucaccgccguggggaaggaguucaacaagcuggagcgccggauggagaaccucaacaagaaggucgacgacggcuuccuggacaucuggacguacaacgccgagcugcucgugcugcuggagaacgagcgcacccucgacuuccacgacagcaacgucaagaaccuguacgagaaggugaagacccagcugaagaacaacgcgaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacagcacgguggccuccagccucguccugcuggugucccucggggccaucagcuucuggaugugcuccaacggcagccugcagugccgcaucugcaucuga

SEQ ID NO: 62026 - RNA, 1701 nt, Artificial Sequence
  derived and/or modified sequence opt1 from hemagglutinin__InfluenzaA__ABG47840
augaaggugaagcugcucguccugcugugcgccuucaccgccaccuacgcggacacgaucugcaucggcuaccacgccaacaacagcaccgacaccguggacaccgugcucgagaagaacgucacggugacccacuccgugaaccugcuggaggacagccacaacgggaagcucugccgccugaagggcaccgcgccccugcagcucgggaacugcuccgucgccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgugagcuccuucgagcgcuucgagaucuucccgaaggagagcuccuggcccaaccacaccgugaccaagggggucaccgccagcugcucccacaacggcaagagcuccuucuacaagaaccugcucuggcugacggagaagaacgggcuguaccccaaccucagcaaguccuacgugaacaacaaggagaaggaggugcugguccuguggggcgugcaccaccccagcaacaucggggaccagcgggccaucuaccacaccgagaacgccuacgugagcgucguguccagccacuacucccgccgguucaccccggagaucgcgaagcgccccaaggugcgggaccaggagggccgcaucaacuacuacuggacccuccuggagcccggcgacacgaucaucuucgaggccaacgggaaccugaucgcccccugguacgccuucgcccucagccggggcuucggguccggcaucaucaccagcaacgcguccaugagcgagugcgacgccaagugccagaccccgcagggcgccaucaacuccagccugcccuuccagaacguccaccccgugaccaucggggagugccccaaguacgugcgcuccacgaagcugcggauggucaccggccuccgcaacaucccgagcauccagucccgggggcuguucggcgccaucgccggguucaucgagggcggcuggaccgggaugaucgacggcugguacggguaccaccaccagaacgagcagggcagcggguacgcggccgaccagaaguccacccagaacgccaucgacggcaucacgaacaaggugaacagcgugaucgagaagaugaacacccaguucaccgccgucggcaaggaguucaacaagcuggagcgccggauggagaaccucaacaagaagguggacgacggguuccuggacaucuggaccuacaacgccgagcugcucguccugcuggagaacgagcgcacgcucgacuuccacgacuccaacgugaagaaccuguacgagaaggugaagaaccagcugaagaacaacgcgaaggagaucggcaacgggugcuucgaguucuaccacaagugcaacaacgagugcauggagagcgucaagaacggcaccuacgacuaccccaaguacuccgaggagagcaagcucaaccgggagaagaucgacggggugaagcuggagagcaugggcguguaccagauccuggccaucuacuccaccgucgccagcucccucgugcugcuggugagccucggcgccaucuccuucuggaugugcagcaacgggucccugcagugccgcaucugcaucuga

SEQ ID NO: 62027 - RNA, 1701 nt, Artificial Sequence
  derived and/or modified sequence opt1 from hemagglutinin__InfluenzaA__ABG47851
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcaacggcaagagcuccaucaugcggagcgacgccccgaucgacaacugcaacuccgagugcaucacccccaacgggagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagagcacccaggcggccaucgaccagaucaacggcaagcugaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacaaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggcuucaucaugugggccugccagaaggggaacauccgcugcagcaucugcaucuga

SEQ ID NO: 62028 - RNA, 1701 nt, Artificial Sequence
  derived and/or modified sequence opt1 from hemagglutinin__InfluenzaA__ABG47862
augcgcaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcggaucugcaacagcccccaccgcauccuggacggcaagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccugaucgccagcuccggcacgcuggaguucaccaacgagggguucaacuggaccggcgucgcccaggacgggaccagcuacgccugcaagcggggcuccgugaaguccuucuucucccgccucaacuggcugcacaagcuggaguacaaguaccccgcgcucaacgugacgaugcccaacaacgacaaguucgacaagcuguacaucuggggcguccaccaccccagcaccgacuccgaccagaccagccuguacgugcaggccuccgggcgggugaccgucagcacgaagcgcagccagcagaccgugaucccgaacaucggcucccggcccugggugcgcggggucagcucccggaucagcaucuacuggaccaucgugaagcccggcgacauccuccugaucaacuccaccgggaaccugaucgcgccccgcggcuacuucaagauccggagcggcaaguccagcaucaugcgcuccgacgccccgaucgggaacugcaacagcgagugcaucacgcccaacggcuccauccccaacgacaagcccuuccagaacgugaaccggaucaccuacggggccugcccgcgcuacgucaagcagaacacccucaagcuggccaccggcaugcggaacgugcccgagaagcagacgcgcgggaucuucggcgccaucgccggcuucaucgagaacgggugggagggcaugguggacgggugguacggcuuccggcaccagaacagcgaggggaccggccaggccgccgaccugaaguccacccaggcggccaucaaccagaucaacggcaagcucaaccgccugaucgagaagaccaacgagaaguuccaccagaucgagaaggaguucagcgaggucgaggggcggauccaggaccuggagaaguacguggaggacacgaagaucgaccucugguccuacaacgccgagcugcugguggcccucgagaaccagcacaccaucgaccugaccgacagcgagaugaacaagcuguucgagcgcacccgcaagcagcuccgggagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcucaagagcggcuacaaggacuggauccuguggaucuccuucgccaucagcugcuuccugcugugcgucgugcuccugggguucaucaugugggccugccagaagggcaacauccggugcaacaucugcaucuga

SEQ ID NO: 62029 - RNA, 1701 nt, Artificial Sequence; identical to SEQ ID NO: 61992
  derived and/or modified sequence opt1 from hemagglutinin__InfluenzaA__ABG47873

SEQ ID NO: 62030 - RNA, 1701 nt, Artificial Sequence; identical to SEQ ID NO: 61997
  derived and/or modified sequence opt1 from hemagglutinin__InfluenzaA__ABG47895

SEQ ID NO: 62031 - RNA, 1701 nt, Artificial Sequence; identical to SEQ ID NO: 61992
  derived and/or modified sequence opt1 from hemagglutinin__InfluenzaA__ABG47906

SEQ ID NO: 62032 - RNA, 1701 nt, Artificial Sequence
  derived and/or modified sequence opt1 from hemagglutinin__InfluenzaA__ABG47917
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 62033 - RNA, 1701 nt, Artificial Sequence; identical to SEQ ID NO: 62032
  derived and/or modified sequence opt1 from hemagglutinin__InfluenzaA__ABG47928

SEQ ID NO: 62034 - RNA, 1701 nt, Artificial Sequence
  derived and/or modified sequence opt1 from hemagglutinin__InfluenzaA__ABG47939
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacucccccuaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 62035 - RNA, 1701 nt, Artificial Sequence
  derived and/or modified sequence opt1 from hemagglutinin__InfluenzaA__ABG47950
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagccugggcacgcucgaguucaucaacgaggacuucaacuggaccgggguggcccaggacggcaaguccuacagcugcaagcgcggguccgugaacagcuucuucucccggcugaacuggcugcacaagcucgaguacaaguaccccgcccugaacgucaccaugcccaacaacggcaaguucgacaagcuguacaucuggggcgugcaccaccccagcaccgacuccgaccagacgagccucuacgcgcgcgccuccgggcgggugaccgucagcaccaagcgcagccagcagaccgugaucccgaacaucggcuuccggcccugggugcgcgggcuguccagccggaucuccaucuacuggacgaucgucaagcccggcgacauccugcucaucaacagcaccgggaaccugaucgcgccccgcggcuacuucaagauccggaccggcaaguccagcaucaugcgcuccgacgccccgaucgggaacugcagcuccgagugcaucacccccaacggcaacauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggcuucaucgagaacgggugggagggcaugguggacgggugguacggcuuccggcaccagaacagcgaggggacgggccaggccgccgaccugaaguccacccaggcggccaucgaccagaucaacggcaagcugaaccgccucaucgagaagaccaacgagaaguuccaccagaucgagaaggaguucagcgagguggaggggcggauccaggaccuggagaaguacgucgaggacaccaagaucgaccugugguccuacaacgccggcuuccucguggcccuggagaaccagcacacgaucgaccugaccgacagcgagaugaacaagcuguucgagcgcacccgcaagcagcuccgggagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggcgucgagcucaagagcggguacaaggacuggauccuguggaucuccuucgccaucagcugcuuccugcucugcgugguccugcugggcuucaucaugugggccugccagaaggggaacauccggugcaacaucugcaucuga

SEQ ID NO: 62036 - RNA, 1701 nt, Artificial Sequence
  derived and/or modified sequence opt1 from hemagglutinin__InfluenzaA__ABG47961
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacuccugcaagcgcgggagcgugaacuccuucuucagccggcucaacuggcugcacaagcuggaguacaaguaccccgcccucaacgucaccaugcccaacaacggcaaguucgacaagcuguacaucuggggcgugcaccaccccuccaccgacagcgaccagacgucccuguacgugcgcgcgagcgggggcgucaccgugagcaccaagcggucccagcagaccgugaucccgaacaucgggagccgccccuggguccggggccucuccagccgcaucuccaucuacuggacgaucgugaagcccggggacauccugcugaucaacagcaccggcaaccucaucgcgccccggggcuacuucaagaugcgcaacgggaaguccagcaucaugcgguccgacgccccgaucggcaacugcagcuccgagugcaucacccccaacgggagcauccccaacgacaagcccuuccagaacgugaaccgcaucaccuacggcgccugcccgcgguacgucaagcagaacacgcugaagcuggccaccgggaugcgcaacgugcccgagaagcagacccggggcaucuucggcgccaucgccggguucaucgagaacggcugggaggggaugguggacggcugguacggguuccgccaccagaacuccgagggcaccggccaggccgccgaccucaagagcacgcaggccgcgaucgaccagaucaacgggaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacaccaucgaccugacggacuccgagaugaacaagcuguucgagcggacccgcaagcagcuccgcgagaacgccgaggacaugggcaacgggugcuucaagaucuaccacaagugcgacaacgccugcaucggcagcauccggaacggcaccuacgaccacgacgucuaccgcgacgaggcgcugaacaaccgguuccagaucaaggggguggagcucaaguccggcuacaaggacuggauccuguggaucagcuucgccaucagcugcuuccugcucugcgucgugcugcugggguucaucaugugggccugccagaagggcaacauccgcugcaacaucugcaucuga

SEQ ID NO: 62037 - RNA, 1701 nt, Artificial Sequence; identical to SEQ ID NO: 62032
  derived and/or modified sequence opt1 from hemagglutinin__InfluenzaA__ABG47972

SEQ ID NO: 62038 - RNA, 1701 nt, Artificial Sequence; identical to SEQ ID NO: 62032
  derived and/or modified sequence opt1 from hemagglutinin__InfluenzaA__ABG47983

SEQ ID NO: 62039 - RNA, 1701 nt, Artificial Sequence; identical to SEQ ID NO: 62032
  derived and/or modified sequence opt1 from hemagglutinin__InfluenzaA__ABG47994

SEQ ID NO: 62040 - RNA, 1701 nt, Artificial Sequence
  derived and/or modified sequence opt1 from hemagglutinin__InfluenzaA__ABG48005
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucaaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 62041 - RNA, 1701 nt, Artificial Sequence; identical to SEQ ID NO: 62032
  derived and/or modified sequence opt1 from hemagglutinin__InfluenzaA__ABG48016

SEQ ID NO: 62042 - RNA, 1701 nt, Artificial Sequence; identical to SEQ ID NO: 62032
  derived and/or modified sequence opt1 from hemagglutinin__InfluenzaA__ABG48027

SEQ ID NO: 62043 - RNA, 1698 nt, Artificial Sequence
  derived and/or modified sequence opt1 from hemagglutinin__InfluenzaA__ABG48049
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcacccacuacucccgccgguucacccccgagaucgccaagcgccccaaggugcgggaccaggagggccgcaucaacuacuacuggacccuccuggagcccggggacacgaucaucuucgaggcgaacggcaaccugaucgccccgcgguacgccuucgcccucagccgcggguucggcuccggcaucaucaccagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacaacgagugcauggaguccgugaagaacgggacguacgacuaccccaaguacagcgaggaguccaagcucaaccgcgagaagaucgacggcgugaagcuggagagcaugggcgucuaccagauccuggccaucuacuccaccguggccagcagccucgugcugcuggucucccucggggccaucagcuucuggaugugcuccaacggcagccugcagugccggaucugcaucuga

SEQ ID NO: 62044 - RNA, 1701 nt, Artificial Sequence; identical to SEQ ID NO: 61658
  derived and/or modified sequence opt1 from hemagglutinin__InfluenzaA__ABG48060

SEQ ID NO: 62045 - RNA, 1701 nt, Artificial Sequence; identical to SEQ ID NO: 61658
  derived and/or modified sequence opt1 from hemagglutinin__InfluenzaA__ABG48071

SEQ ID NO: 62046 - RNA, 1701 nt, Artificial Sequence
  derived and/or modified sequence opt1 from hemagglutinin__InfluenzaA__ABG48082
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcgguccaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcugcaccccgggacggacagcgaccagaucucccucuacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccugcugaucaacagcaccggcaaccucaucgcgccccggggguacuucaagauccgcuccggcaagagcuccaucaugcggagcgacgccccgaucggcaagugcaacuccgagugcaucacccccaacgggagcauccccaacggcaagcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugauggacgggugguacggcuuccgccaccagaacuccgaggggaccggccaggccgccgaccucaagagcacgcaggcggccaucaaccagaucaacggcaagcugaaccggcugaucgagaagaccaacgagaaguuccaccagaucgagaaggaguucuccgagguggaggggcgcauccaggaccucgagaaguacgucgaggacaccaagaucgaccuguggagcuacaacgccgagcugcucguggcccuggagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcucaaguccggcuacaaggacuggauccuguggaucagcuucgccaucagcugcuuccugcucugcaucgugcugcugggguucaucaugugggccugccagaagggcaacauccggugcaacaucugcaucuga

SEQ ID NO: 62047 - RNA, 1701 nt, Artificial Sequence
  derived and/or modified sequence opt1 from hemagglutinin__InfluenzaA__ABG48104
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagccgcgccuacuccaacugcuaccccuacgacgugccggacuacgucagccuccggucccugguggcgagcuccggcacgcuggaguucaacaacgagagcuucaacuggaccgggguggcccagaacggcaccuccagcgccugcaagcgccgguccgacaagagcuucuucucccgccucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgggugaccgucagcaccaagcgcucccagcagaccgugaucccgaacaucggcagccggcccugggugcgcggcgucuccagccggaucuccaucuacuggacgaucgugaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggccgcgaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgcgagaacgccgaggacauggggaacggcugcuucaagaucuaccacaagugcgacaacgccugcaucgggagcauccggaacggcaccuacgaccacgacguguaccgcgacgaggcgcugaacaaccgguuccagaucaagggggucgagcugaaguccggcuacaaggacuggauccucuggaucagcuucgccaucagcugcuuccugcugugcaucgugcuccugggcuucaucaugugggccugccagaaggggaacauccgcugcaacaucugcaucuga

SEQ ID NO: 62048 - RNA, 1701 nt, Artificial Sequence; identical to SEQ ID NO: 61648
  derived and/or modified sequence opt1 from hemagglutinin__InfluenzaA__ABG48115

SEQ ID NO: 62049 - RNA, 1701 nt, Artificial Sequence; identical to SEQ ID NO: 61655
  derived and/or modified sequence opt1 from hemagglutinin__InfluenzaA__ABG48126

SEQ ID NO: 62050 - RNA, 1701 nt, Artificial Sequence; identical to SEQ ID NO: 61570
  derived and/or modified sequence opt1 from hemagglutinin__InfluenzaA__ABG48148

SEQ ID NO: 62051 - RNA, 1701 nt, Artificial Sequence; identical to SEQ ID NO: 61570
  derived and/or modified sequence opt1 from hemagglutinin__InfluenzaA__ABG48159

SEQ ID NO: 62052 - RNA, 1701 nt, Artificial Sequence
  derived and/or modified sequence opt1 from hemagglutinin__InfluenzaA__ABG48170
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugaaguccgacgccccgaucggcaagugcaacuucgagugcaucacccccaacggguccauccccaacggcaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacagcgaggggaccggccaggccgccgaccugaaguccacgcaggcggccaucaaccagaucaacggcaagcucaaccgccugaucgagaagaccaacgagaaguuccaccagaucgagaaggaguucagcgagguggaggggcggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgccgaggacaugggcaacgggugcuucaagaucuaccacaagugcgacaacgcgugcaucggcuccauccgcaacgggaccuacgaccacgacguguaccgcgacgaggcccugaacaaccgguuccagaucaagggcgucgagcucaagagcggcuacaaggacuggauccuguggaucuccuucgccaucagcugcuuccugcugugcaucgugcuccugggguucaucaugugggccugccagaagggcaacauccgcugcaacaucugcaucuga

SEQ ID NO: 62053 - RNA, 1701 nt, Artificial Sequence
  derived and/or modified sequence opt1 from hemagglutinin__InfluenzaA__ABG48181
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccuacgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccuccgggcgcgugaccgucagcaccaagcggagccagcagaccgugaucccgaacaucggcucccgccccugggugcggggcgucagcucccgcaucagcaucuacuggacgaucgugaagcccggggacauccuccugaucaacuccaccggcaaccugaucgcgccccggggguacuucaagauccgcagcggcaaguccagcaucaugcgguccgacgccccgaucggcaagugcaacagcgagugcaucacccccaacggguccauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacagcgagggcaccgggcaggccgccgaccugaaguccacgcaggcggccaucaaccagaucaacggcaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcugaaguccggcuacaaggacugggugcucuggaucuccuucgccaucagcugcuuccugcugugcaucguccuccugggcuucaucaugugggccugccagaaggggaacauccggugcaacaucugcaucuga

SEQ ID NO: 62054 - RNA, 1701 nt, Artificial Sequence; identical to SEQ ID NO: 61570
  derived and/or modified sequence opt1 from hemagglutinin__InfluenzaA__ABG48192

SEQ ID NO: 62055 - RNA, 1701 nt, Artificial Sequence
  derived and/or modified sequence opt1 from hemagglutinin__InfluenzaA__ABG48203
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacgugugcaucuga

SEQ ID NO: 62056 - RNA, 1701 nt, Artificial Sequence; identical to SEQ ID NO: 61524
  derived and/or modified sequence opt1 from hemagglutinin__InfluenzaA__ABG48214

SEQ ID NO: 62057 - RNA, 1701 nt, Artificial Sequence; identical to SEQ ID NO: 61524
  derived and/or modified sequence opt1 from hemagglutinin__InfluenzaA__ABG48236

SEQ ID NO: 62058 - RNA, 1701 nt, Artificial Sequence
  derived and/or modified sequence opt1 from hemagglutinin__InfluenzaA__ABG48247
augaagaccaucaucgcccugagcuacauccucugccugguguucgcccagaagcugcccggcaacgacaacaacaccgcgacgcucugccuggggcaccacgccgucccgaacggcaccaucgugaagaccaucaccaacgaccagaucgaggugacgaacgccaccgagcugguccaguccagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggaccacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 62059 - RNA, 1701 nt, Artificial Sequence
  derived and/or modified sequence opt1 from hemagglutinin__InfluenzaA__ABG48269
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcucccccaccgggggcaucugcgacagcccccaccagauccucgacggggagaacugcacccugaucgacgcccugcucggcgacccccagugcgacggcuuccagaacaagaagugggaccuguucguggagcgcuccaaggcccacagcaacugcuacccguacgacgugcccgacuacgcgucccugcggagccucgucgccuccagcgggacgcuggaguucaacaacgaguccuucaacuggaccggcgugacccagaacgggaccagcuccgccugcaagcgccggagcaacaaguccuucuucagccgccugaacuggcucacgcaccugaaguucaaguaccccgcccugaacgugaccaugcccaacaacgagaaguucgacaagcucuacaucuggggcguccaccacccggggaccgacaacgaccagaucucccuguacgcgcaggccagcggccggaucaccguguccacgaagcgcagccagcagaccgugauccccaacaucggcagccggccccgcguccgggacgugcccucccgcaucagcaucuacuggaccaucgugaagccgggggacauccugcucaucaacuccaccggcaaccugaucgcgccccggggguacuucaagauccgcagcggcaaguccagcaucaugcgguccgacgcccccaucggcaagugcaacagcgagugcaucacgcccaacggguccaucccgaacgacaagcccuuccagaacgucaaccgcaucaccuacggcgccugcccccgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 62060 - RNA, 1701 nt, Artificial Sequence
  derived and/or modified sequence opt1 from hemagglutinin__InfluenzaA__ABG48291
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcgggagcuacgccugcaagcgcggcuccgugaacagcuucuucucccggcucaacuggcugcacaagagcgaguacaaguaccccgcgcugaacgucuccaugcccaacaacgggaaguucaacaagcucuacaucuggggcgugcaccaccccagcaccgacuccgaccagaccagccuguacgugcgcgccagcggccgggucacgguguccaccaagcgcagccagcagaccgugaccccgaacaucgggucccggcccuggguccgcggccugagcucccggaucagcaucuacuggacgaucgugaagcccggggacauccuccugaucaacuccaccggcaaccugaucgcgccccgcggcuacuucaagauccggaacggcaagagcuccaucaugcgcagcgacgccccgaucgggaccugcuccuucgagugcaucacccccaacgggagcauccccaacgacaagcccuuccagaacgugaaccggaucacguacggcgccugcccgcgcuacgucaagcagaacacccucaagcuggccaccgggaugcggaacgugcccgagaagcagacccgcggcaucuucggcgccaucgccggguucaucgagaacggcugggaggggaugguggacggcugguacggguuccggcaccagaacuccgagggcacgggccaggccgccgaccugaaguccacccaggcggccaucgaccagaucaacgggaagcucaaccgccugaucgagaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacacgaucgaccugaccgacuccgagaugaacaagcuguucgagaagacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaagggcguggagcugaaguccggguacaaggacuggauccucuggaucagcuucgccaucagcugcuuccugcugugcgucgugcuccugggcuucaucaugugggccugccagaaggggaacauccgcugcaacaucugcaucuga

SEQ ID NO: 62061 - RNA, 1701 nt, Artificial Sequence
  derived and/or modified sequence opt1 from hemagglutinin__InfluenzaA__ABG48335
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcucccggcccuggguccgcgggcucagcucccggaucagcaucuacuggacgaucgugaagcccggcgacauccugcugaucaacuccaccgggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 62062 - RNA, 1701 nt, Artificial Sequence
  derived and/or modified sequence opt1 from hemagglutinin__InfluenzaA__ABG48346
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcaacaaggccuacuccaacugcuaccccuacgacgugccggacuacgcgucccuccggagccuggucgccuccagcggcacgcuggaguucaucaacgaggacuucaacuggaccgggguggcccaggacggcaaguccuacgccugcaagcgcgggagcgugaacuccuucuucagccggcucaacuggcugcacaagcuggaguacaaguaccccgcgcucaacgucaccaugcccaacaacggcaaguucgacaagcuguacaucuggggcgugcaccaccccuccaccgacagcgaccagacgucccuguacgugcgcgccagcgggcgggucaccguguccaccaagcgcagccagcagaccgugaucccgaacaucggcagccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgaccggcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacaccaucgaccugacggacuccgagaugaacaagcuguucgagcgcacccggaagcagcuccgcgagaacgccgaggacaugggcaacgggugcuucaagaucuaccacaagugcgacaacgcgugcaucggcagcauccggaacgggaccuacgaccacgacgucuaccgcgacgaggcccugaacaaccgguuccagaucaagggcguggagcucaaguccggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 62063 - RNA, 1701 nt, Artificial Sequence; identical to SEQ ID NO: 62061
  derived and/or modified sequence opt1 from hemagglutinin__InfluenzaA__ABG48357

SEQ ID NO: 62064 - RNA, 1701 nt, Artificial Sequence
  derived and/or modified sequence opt1 from hemagglutinin__InfluenzaA__ABG48368
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcucccggcccuggguccgcgggcucagcucccggaucagcaucuacuggacgaucgugaagcccggcgacauccugcugaucaacuccaccgggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacagcgagaugaacaagcuguucgagcgcacccgcaagcagcuccgggagaacgccgaggacaugggcaacgggugcuucaaggucuaccacaagugcgacaacgcgugcaucgaguccauccgcaacggcaccuacgaccacgacguguaccgggacgaggcccugaacaaccgcuuccagaucaagggggucgagcucaagagcggcuacaaggacuggauccuguggaucuccuucgccaucagcugcuuccugcucugcguggugcugcugggcuucaucaugugggccugccagaaggggaacauccggugcaacaucugcaucuga

SEQ ID NO: 62065 - RNA, 1701 nt, Artificial Sequence; identical to SEQ ID NO: 61915
  derived and/or modified sequence opt1 from hemagglutinin__InfluenzaA__ABG67135

SEQ ID NO: 62066 - RNA, 1701 nt, Artificial Sequence; identical to SEQ ID NO: 61791
  derived and/or modified sequence opt1 from hemagglutinin__InfluenzaA__ABG67146

SEQ ID NO: 62067 - RNA, 1701 nt, Artificial Sequence
  derived and/or modified sequence opt1 from hemagglutinin__InfluenzaA__ABG67157
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcaacagcccccaccggaucaucgacggcaagaacugcacccugaucgacgcccugcucggggacccccacugcgacggcuuccagaacaaggagugggaccuguucguggagcgcuccaaggccuacagcaacugcuacccguacgacgugcccgacuacgcgucccugcggagccucgucgccuccagcggcacgcuggaguucaucaacgagaacuucaacuggaccgggguggcccaggacggcaaguccuacgccugcaagcgcgggagcgugaacuccuucuucagccggcugaacuggcuccacaagcuggaguacaaguaccccgcgcugaacgucaccaugcccaacaacggcaaguucgacaagcucuacaucuggggcgugcaccacccguccaccgacagcgaccagacgucccuguacgugcgcgccagcgggcgggucaccguguccaccaagcgcagccagcagaccgugauccccgacaucggcuaccggcccuggguccgcgggcugagcucccggaucagcaucuacuggacgaucgugaagcccggcgacauccuccugaucaacuccaccgggaaccugaucgccccgcgcggcuacuucaagcuccggaacggcaagagcuccaucaugcgcagcgacgcccccaucgggaacugcuccagcgagugcaucacccccaacggcuccauccccaacgacaagccguuccagaacgugaaccggaucaccuacggggccugcccccgcuacaucaagcagaacacgcugaagcuggcgaccggcaugcggaacguccccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccugguggagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacagcgagaugaacaagcuguucgagcgcaccaagaagcagcuccgcgagaacgccgaggacaugggcaacgggugcuucaagaucuaccacaagugcgacaacgcgugcaucggcuccauccggaacgggaccuacgaccacgacgucuaccgcgacgaggcccugaacaaccgguuccagaucaagggcguggagcucaagagcggcuacaaggacuggauccuguggaucuccuucgccaucagcugcuuccugcucugcgucgugcugcugggguucaucaugugggccugccagaagggcaacauccgcugcaacaucugcaucuga

SEQ ID NO: 62068 - RNA, 1701 nt, Artificial Sequence; identical to SEQ ID NO: 61992
  derived and/or modified sequence opt1 from hemagglutinin__InfluenzaA__ABG67168

SEQ ID NO: 62069 - RNA, 1701 nt, Artificial Sequence; identical to SEQ ID NO: 61992
  derived and/or modified sequence opt1 from hemagglutinin__InfluenzaA__ABG67179

SEQ ID NO: 62070 - RNA, 1701 nt, Artificial Sequence
  derived and/or modified sequence opt1 from hemagglutinin__InfluenzaA__ABG67190
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuuccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuacccguacgacgugcccgacuacgcgagccuccggucccuggucgccagcuccggcacgcuggaguucaccaacgagaacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccacccgagcacggacuccgaccagaccagccuguacgugcgcgccuccgggaaggucaccgugagcaccaagcggucccagcagacggugauccccgacaucggcuaccgccccuggguccgggggcucagcagccgcaucuccaucuacuggaccaucgugaagcccggcgacauccugcugaucaacagcaccgggaaccucaucgccccgcggggcuacuucaagauccgcaacggcaaguccagcaucaugcgguccgacgcccccaucgggaacugcagcuccgagugcaucacccccaacggcagcauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagagcacccaggcggccaucgaccagaucaacggcaagcugaaccggcuggucgagaagaccaacgagaaguuccaccagaucgagaaggaguucuccgagguggaggggcgcauccaggaccucgagaaguacguggaggacaccaagaucgaccuguggagcuacaacgccgagcugcucgucgcccuggagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcgucgagcucaaguccggcuacaaggacuggauccuguggaucagcuucgccaucuccugcuuccugcucugcguggugcugcugggguucaucaugugggccugccagaagggcaacauccgcugcaacaucugcaucuga

SEQ ID NO: 62071 - RNA, 1701 nt, Artificial Sequence
  derived and/or modified sequence opt1 from hemagglutinin__InfluenzaA__ABG67212
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguaccgcuaccccgcgcucaacgucaccaugcccaacaacggcaaguucgacaagcuguacaucuggggcgugcaccaccccagcaccgacuccgaccagacgagccuguacgugcgggccuccgggcgcgucaccgugagcaccaagcggagccagcagaccgugaucccgaacaucggcuuccgccccuggguccgggggcucuccagccgcaucuccaucuacuggacgaucgugaagcccggcgacauccugcugaucaacagcaccgggaaccucaucgcgccccggggcuacuucaagauccgcaacggcaaguccagcaucaugcgguccgacgccccgaucgggaacugcagcuccgagugcaucacccccaacggcagcauccccaacgacaagcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggagcuacaacgccggccugcucguggcccuggagaaccagcacaccaucgaccugacggacuccgagaugaacaagcuguucgagcgcacccggaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaagggcguggagcucaaguccggguacaaggacuggauccuguggaucagcuucgccaucuccugcuuccugcucugcgucgugcugcugggcuucaucaugugggccugccagaaggggaacauccgcugcaacaucugcaucuga

SEQ ID NO: 62072 - RNA, 1701 nt, Artificial Sequence; identical to SEQ ID NO: 62032
  derived and/or modified sequence opt1 from hemagglutinin__InfluenzaA__ABG67223

SEQ ID NO: 62073 - RNA, 1701 nt, Artificial Sequence
  derived and/or modified sequence opt1 from hemagglutinin__InfluenzaA__ABG67234
augaagaccaucaucgcccugagcuacauccucugccugguguucgcccagaagcugcccggcgacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucguggagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 62074 - RNA, 1701 nt, Artificial Sequence
  derived and/or modified sequence opt1 from hemagglutinin__InfluenzaA__ABG67245
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucgacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 62075 - RNA, 1698 nt, Artificial Sequence; identical to SEQ ID NO: 61750
  derived and/or modified sequence opt1 from hemagglutinin__InfluenzaA__ABG67477

SEQ ID NO: 62076 - RNA, 1698 nt, Artificial Sequence; identical to SEQ ID NO: 61808
  derived and/or modified sequence opt1 from hemagglutinin__InfluenzaA__ABG67491

SEQ ID NO: 62077 - RNA, 1701 nt, Artificial Sequence
  derived and/or modified sequence opt1 from hemagglutinin__InfluenzaA__ABG67502
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugagcgacuacgucucccuccgcagccugguggcguccagcggcacgcuggaguucaacaacgaguccuucaacuggaccgggguggcccagaacggcaccagcuccgccugcaagcggcgcagcgacaaguccuucuucagccggcucaacuggcugcaccagcugaaguacaaguacccggcccucaacgucaccaugcccaacaacgagaaguucgacaagcuguacaucuggggcgugcaccaccccgggacggacuccgaccagaucagccuguacgcgcaggccagcgggcgcgugaccgucuccaccaagcggagccagcagaccgugauccccaacaucggcucccgcccgugggugcggggcaucagcucccgcaucagcaucuacuggacgaucgucaagcccggggacauccuccugaucaacuccaccggcaaccugaucgcgccccggggguacuucaagauccgcagcggcaaguccagcaucaugcgguccgacgcccccaucggcaagugcaacagcgagugcaucaccccgaacggguccauccccaacgacaagcccuuccagaacgugaaccgcaucaccuacggccccugcccgcgguacgugaagcagaacacgcucaagcuggccaccgggaugcgcaacguccccgagaagcagacccggggcaucuucggggccaucgccggcuucaucgagaacggcugggaggggaugauggacggcugguacggguuccgccaccagaacagcgagggcaccgggcaggccgccgaccugaaguccacgcaggccgcgaucaaccagaucaacggcaagcucaaccggcugaucgagaagaccaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgccugcaucggguccauccgcaacggcaccuacgaccacgacguguaccgggacgaggcgcugaacaaccgcuuccagaucaaggggguggagcugaaguccggcuacaaggacuggauccucuggaucagcuucgccaucuccugcuuccugcugugcaucguccuccugggcuucaucaugugggccugccagaaggggaacauccggugcaacaucugcaucuga

SEQ ID NO: 62078 - RNA, 1701 nt, Artificial Sequence
  derived and/or modified sequence opt1 from hemagglutinin__InfluenzaA__ABG67524
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagccgcgccuacuccaacugcuaccccuacgacgugccggacuacgucagccuccggucccugguggcgagcuccggcacgcuggaguucaacaacgagagcuucaacuggaccgggguggcccagaacggcaccuccagcgccugcaagcgccgguccgacaagagcuucuucucccgccucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgggugaccgucagcaccaagcgcucccagcagaccgugaucccgaacaucggcagccggcccugggugcgcggcgucuccagccggaucuccaucuacuggacgaucgugaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggccgcggugaaccagaucaacggcaagcucaaccgccugaucgagaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagcgcaccaagaagcagcuccgcgagaacgccgaggacauggggaacggcugcuucaagaucuaccacaagugcgacaacgccugcaucgggagcauccggaacggcaccuacgaccacgacgucuaccgcgacgaggcgcugaacaaccgguuccagaucaaggggguggagcugaaguccggcuacaaggacuggauccucuggaucagcuucgccaucagcugcuuccugcugugcaucguccuccugggcuucaucaugugggccugccagaaggggaacauccgcugcaacaucugcaucuga

SEQ ID NO: 62079 - RNA, 1701 nt, Artificial Sequence; identical to SEQ ID NO: 61570
  derived and/or modified sequence opt1 from hemagglutinin__InfluenzaA__ABG67535

SEQ ID NO: 62080 - RNA, 1701 nt, Artificial Sequence; identical to SEQ ID NO: 61524
  derived and/or modified sequence opt1 from hemagglutinin__InfluenzaA__ABG67546

SEQ ID NO: 62081 - RNA, 1701 nt, Artificial Sequence
  derived and/or modified sequence opt1 from hemagglutinin__InfluenzaA__ABG67557
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcgaccaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 62082 - RNA, 1701 nt, Artificial Sequence; identical to SEQ ID NO: 61524
  derived and/or modified sequence opt1 from hemagglutinin__InfluenzaA__ABG67568

SEQ ID NO: 62083 - RNA, 1701 nt, Artificial Sequence; identical to SEQ ID NO: 61524
  derived and/or modified sequence opt1 from hemagglutinin__InfluenzaA__ABG67579

SEQ ID NO: 62084 - RNA, 1701 nt, Artificial Sequence; identical to SEQ ID NO: 61524
  derived and/or modified sequence opt1 from hemagglutinin__InfluenzaA__ABG67590

SEQ ID NO: 62085 - RNA, 1701 nt, Artificial Sequence; identical to SEQ ID NO: 61524
  derived and/or modified sequence opt1 from hemagglutinin__InfluenzaA__ABG67601

SEQ ID NO: 62086 - RNA, 1701 nt, Artificial Sequence; identical to SEQ ID NO: 61524
  derived and/or modified sequence opt1 from hemagglutinin__InfluenzaA__ABG67612

SEQ ID NO: 62087 - RNA, 1701 nt, Artificial Sequence; identical to SEQ ID NO: 61524
  derived and/or modified sequence opt1 from hemagglutinin__InfluenzaA__ABG67623

SEQ ID NO: 62088 - RNA, 1701 nt, Artificial Sequence
  derived and/or modified sequence opt1 from hemagglutinin__InfluenzaA__ABG67634
augaagaccaucaucgcccugagcuacauccucugccugguguucgcccagaagcugcccggcaacgacaacaacaccgcgacgcucugccuggggcaccacgccgucccgaacggcaccaucgugaagaccaucaccaacgaccagaucgaggugacgaacgccaccgagcugguccaguccagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggaccacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcaagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 62089 - RNA, 1701 nt, Artificial Sequence; identical to SEQ ID NO: 61524
  derived and/or modified sequence opt1 from hemagglutinin__InfluenzaA__ABG67645

SEQ ID NO: 62090 - RNA, 1701 nt, Artificial Sequence
  derived and/or modified sequence opt1 from hemagglutinin__InfluenzaA__ABG67656
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucgacugggccggcgugacccagaacgggaccuccagcgccugcaagcgccgguccaacaagagcuucuucucccgccugaacuggcucacccaccugaaguacaaguaccccgcgcugaacgugacgaugcccaacaacgagaaguucgacaagcucuacaucuggggcguccaccaccccgggaccgacagcgaccagaucucccuguacgcccaggccagcggccggaucaccgugagcaccaagcgcucccagcagacggugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaaccgcaucacguacggcgccugcccgcgguacgugaagcagaacacccugaagcucgccaccgggaugcgcaacgugcccgagaagcagacccggggcaucuucggggccaucgccggcuucaucgagaacggcugggaggggauggucgacggcugguacggguuccgccaccagaacuccgagggcacggggcaggccgcggaccugaaguccacccaggccgccaucaaccagaucaacggcaagcugaaccggcucaucggcaagaccaacgagaaguuccaccagaucgagaaggaguucuccgagaucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgcggaggacaugggcaacgggugcuucaagaucuaccacaagugcgacaacgccugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucagcugcuuccuccugugcguggcccugcucggguucaucaugugggcgugccagaagggcaacauccggugcaacaucugcaucuga

SEQ ID NO: 62091 - RNA, 1701 nt, Artificial Sequence
  derived and/or modified sequence opt1 from hemagglutinin__InfluenzaA__ABG67667
augaagaccaucaucgcccugagcuacauccucugccagguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaccaacgagggguucaacuggaucggcguggcccaggacgggaaguccuacgccugcaagcgcggcuccgugaacagcuucuucucccggcugaacuggcuccacaagcuggaguacaaguaccccgcgcugaacgucaccaugcccaacaacgacaaguucgacaagcucuacaucuggggcgugcaccaccccagcaccgacuccgaccagacgagccuguacgugcaggccuccgggcgcgucaccgugagcaccaagcggagccagcagaccgugaucccgaacaucggcucccgccccuggguccgggggaucagcucccgcaucagcaucuacuggacgaucgugaagcccggcgacauccugcucaucaacuccaccgggaaccugaucgcgccccggggcuacuucaagauccgcaacggcaagagcuccaucaugcggagcgacgccccgaucgacaacugcaacuccgagugcaucacccccaacgggagcauccccaacgacaagcccuuccagaacgugaaccgcaucaccuacggcgccugcccgcgguacgucaagcagaacacgcugaagcucgccaccgggaugcgcaacgugcccgagaagcagacccggggcaucuucggggccaucgccggcuucaucgagaacggcugggaggggaugaucgacggcugguacggguuccgccaccagaacuccgagggcaccgggcaggccgccgaccucaagagcacgcaggcggccaucgaccagaucaacggcaagcugaaccggcugaucgagaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagcggacccgcaagcagcugcgcgagaacgccgaggacauggggaacggcugcuucaagaucuaccacaagugcgacaacgcgugcaucgggagcauccggaacggcaccuacgaccacgacguguaccgcgacgaggcccucaacaaccgguuccagaucaagggggucgagcugaaguccggcuacaaggacuggauccuguggaucagcuucgccaucuccugcuuccuccugugcgugguccugcucggcuucaucaugugggccugccagaaggggaacauccgcugcaacaucugcaucuga

SEQ ID NO: 62092 - RNA, 1701 nt, Artificial Sequence
  derived and/or modified sequence opt1 from hemagglutinin__InfluenzaA__ABG79941
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccuccugaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcuccaucugcaucuga

SEQ ID NO: 62093 - RNA, 1701 nt, Artificial Sequence; identical to SEQ ID NO: 61929
  derived and/or modified sequence opt1 from hemagglutinin__InfluenzaA__ABG79952

SEQ ID NO: 62094 - RNA, 1701 nt, Artificial Sequence; identical to SEQ ID NO: 61992
  derived and/or modified sequence opt1 from hemagglutinin__InfluenzaA__ABG79974

SEQ ID NO: 62095 - RNA, 1701 nt, Artificial Sequence; identical to SEQ ID NO: 61992
  derived and/or modified sequence opt1 from hemagglutinin__InfluenzaA__ABG79985

SEQ ID NO: 62096 - RNA, 1701 nt, Artificial Sequence
  derived and/or modified sequence opt1 from hemagglutinin__InfluenzaA__ABG79996
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggagccuggucgccuccagcggcacgcuggaguucaccaacgagaacuucaacuggaccgggguggcccaggacggcaaguccuacagcugcaagcgcggguccgugaacagcuucuucucccggcucaacuggcugcacaagcuggaguacaaguaccccgcccucaacgucaccaugcccaacaacggcaaguucgacaagcuguacaucuggggcgugcaccacccgagcacggacuccgaccagaccagccuguacgugcgcgcguccgggaaggucaccgugagcaccaagcggagccagcagacggugauccccgacaucggcuaccgccccuggguccgggggcucuccagccgcaucuccaucuacuggaccaucgugaagcccggcgacauccugcugaucaacagcaccgggaaccucaucgccccgcggggcuacuucaagauccgcaacggcaaguccagcaucaugcgguccgacgcccccaucgggaacugcagcuccgagugcaucacccccaacggcagcauccccaacgacaagccguuccagaacgugaaccgcaucacguacggggccugcccccgguacgucaagcagaacacccugaagcuggccaccggcaugcgcaacgugcccgagaagcagacccgggggaucuucggcgcgaucgccggcuucaucgagaacgggugggagggcaugguggacgggugguacggcuuccgccaccagaacuccgaggggacgggccaggccgccgaccucaagagcacccaggccgcgaucgaccagaucaacggcaagcugaaccggcuggucgagaagaccaacgagaaguuccaccagaucgagaaggaguucuccgagguggaggggcgcauccaggaccucgagaaguacguggaggacaccaagaucgaccuguggagcuacaacgccgagcugcucgucgcccuggagaaccagcacacgaucgaccugaccgacuccgagaugaacaagcuguucgagcggacccgcaagcagcuccgcgagaacgccgaggacaugggcaacgggugcuucaagaucuaccacaagugcgacaacgccugcaucggcagcauccggaacgggaccuacgaccacgacguguaccgcgacgaggcgcugaacaaccgguuccagaucaagggcgucgagcucaaguccggcuacaaggacuggauccuguggaucagcuucgccaucuccugcuuccugcucugcguggugcugcugggguucaucaugugggccugccagaagggcaacauccgcugcaacaucugcaucuga

SEQ ID NO: 62097 - RNA, 1701 nt, Artificial Sequence; identical to SEQ ID NO: 61992
  derived and/or modified sequence opt1 from hemagglutinin__InfluenzaA__ABG80007

SEQ ID NO: 62098 - RNA, 1701 nt, Artificial Sequence; identical to SEQ ID NO: 61992
  derived and/or modified sequence opt1 from hemagglutinin__InfluenzaA__ABG80018

SEQ ID NO: 62099 - RNA, 1701 nt, Artificial Sequence; identical to SEQ ID NO: 61997
  derived and/or modified sequence opt1 from hemagglutinin__InfluenzaA__ABG80029

SEQ ID NO: 62100 - RNA, 1701 nt, Artificial Sequence; identical to SEQ ID NO: 61997
  derived and/or modified sequence opt1 from hemagglutinin__InfluenzaA__ABG80040

SEQ ID NO: 62101 - RNA, 1701 nt, Artificial Sequence; identical to SEQ ID NO: 61992
  derived and/or modified sequence opt1 from hemagglutinin__InfluenzaA__ABG80051

SEQ ID NO: 62102 - RNA, 1701 nt, Artificial Sequence
  derived and/or modified sequence opt1 from hemagglutinin__InfluenzaA__ABG80062
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaaggagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagauccgcaacggcaagagcuccaucaugcggagcgacgccccgaucgggaacugcaacuccgagugcaucacccccaacggcagcauccccaacgacaagcccuuccagaacgugaaccgcaucacguacggggccugcccgcgguacgucaagcagaacacccucaagcuggccaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagagcacccaggcggccaucgaccagaucaacggcaagcugaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggaccuacgaccacgacgucuaccgcgacgaggcccugaacaaccgguuccagaucaagggcguggagcugaagacgggcuacaaggacuggauccucuggaucuccuucgccaucagcugcuuccugcugugcgucgugcuccugggguucaucaugugggccugccagaagggcaacauccgcugcaacaucugcaucuga

SEQ ID NO: 62103 - RNA, 1701 nt, Artificial Sequence
  derived and/or modified sequence opt1 from hemagglutinin__InfluenzaA__ABG80073
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggaccccaacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgaggacuucaacuggaccgggguggcccaggacggcgggagcuacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccagcacggacuccgaccagaccagccuguacgugcgcgccuccggccgggucaccgugagcaccaagcgcagccagcagacggugaccccgaacaucgggucccggcccuggguccgcggccucagcucccggaucagcaucuacuggaccaucgugaagcccggggacauccugcugaucaacuccaccggcaaccucaucgcgccccgcggcuacuucaagauccggaacgggaaguccuccaucaugcgcagcgacgccccgaucggcacgugcuccagcgagugcaucacccccaacggguccauccccaacgacaagcccuuccagaacgugaaccggaucaccuacggcgccugcccgcgcuacgucaagcagaacacccugaagcuggccacggggaugcggaacgugcccgagaagcagacccgcggcaucuucggcgccaucgccggguucaucgagaacggcugggaggggaugguggacggcugguacggguuccggcaccagaacagcgagggcaccggccaggccgccgaccucaaguccacccaggcggccaucgaccagaucaacgggaagcugaaccgccugaucgagaagacgaacgagaaguuccaccagaucgagaaggaguucagcgaggucgagggccggauccaggaccucgagaaguacguggaggacaccaagaucgaccugugguccuacaacgccgagcugcucguggcccuggagaaccagcacaccaucgaccugaccgacagcgagaugaacaagcuguucgagaagacgcgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcucugcgucgugcugcugggcuucaucaugugggccugccagaaggggaacauccgcugcaacaucugcaucuga

SEQ ID NO: 62104 - RNA, 1701 nt, Artificial Sequence
  derived and/or modified sequence opt1 from hemagglutinin__InfluenzaA__ABG80084
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagcggcaucuccaucuacuggacgaucgugaagcccggggacauccugcugaucaacagcaccggcaaccucaucgcgccccggggcuacuucaagauccgcaacgggaaguccagcaucaugcgguccgacgccccgaucggcaacugcagcuccgagugcaucacccccaacgggagcauccccaacgacaagcccuuccagaacgugaaccgcaucaccuacggcgccugcccgcgguacgucaagcagaacacgcugaagcuggccaccgggaugcgcaacgugcccgagaagcagacccggggcaucuucggcgccaucgccggguucaucgagaacggcugggaggggaugguggacggcugguacggguuccgccaccagaacuccgagggcaccggccaggccgccgaccucaagagcacgcaggcggccaucgaccagaucaacgggaagcugaaccggcugaucgagaagaccaacgagaaguuccaccagaucgagaaggaguucuccgaggucgagggccgcauccaggaccucgagaaguacguggaggacaccaagaucgaccuguggagcuacaacgccgggcugcucguggcccuggagaaccagcacaccaucgaccugacggacuccgagaugaacaagcuguucgagcggacccgcaagcagcuccgcgagaacgccgaggacaugggcaacgggugcuucaagaucuaccacaagugcgacaacgcgugcaucggcagcauccggaacggcaccuacgaccacgacaucuaccgcgacgaggcccugaacaaccgguuccagaucaagggggucgagcucaaguccggcuacaaggacuggauccuguggaucagcuucgccaucuccugcuuccugcucugcgugguccugcugggguucaucaugugggccugccagaagggcaacauccgcugcaacaucugcaucuga

SEQ ID NO: 62105 - RNA, 1701 nt, Artificial Sequence
  derived and/or modified sequence opt1 from hemagglutinin__InfluenzaA__ABG80095
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaagguggacaagcuguacaucuggggcgugcaccaccccagcaccgacuccgaccagacgagccuguacguccgcgccuccgggcgggugaccgugagcaccaagcgcagccagcagaccgucaucccgaacaucggcuuccggcccugggugcgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgucaaccggaucaccuacggggccugcccgcgcuacgugaagcagaacacgcugaagcuggccaccggcaugcggaacgugcccgagaagcagacccgcgggaucuucggcgccaucgccggcuucaucgagaacgggugggagggcauggucgacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgagguggaggggcggauccaggaccucgagaaguacguggaggacaccaagaucgaccuguggagcuacaacgccggccugcucgucgcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggcgucgagcucaaguccggguacaaggacuggauccuguggaucagcuucgccaucuccugcuuccugcucugcguggugcugcugggcuucaucaugugggccugccagaaggggaacauccggugcaacaucugcaucuga

SEQ ID NO: 62106 - RNA, 1701 nt, Artificial Sequence; identical to SEQ ID NO: 62032
  derived and/or modified sequence opt1 from hemagglutinin__InfluenzaA__ABG80106

SEQ ID NO: 62107 - RNA, 1701 nt, Artificial Sequence
  derived and/or modified sequence opt1 from hemagglutinin__InfluenzaA__ABG80117
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgugaagcagacccgcgggaucuucggcgccaucgccggcuucaucgagaacgggugggagggcauggucgacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgagguggaggggcggauccaggaccucgagaaguacguggaggacaccaagaucgaccuguggagcuacaacgccggccugcucgucgcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggcgucgagcucaaguccggguacaaggacuggauccuguggaucagcuucgccaucuccugcuuccugcucugcguggugcugcugggcuucaucaugugggccugccagaaggggaacauccggugcaacaucugcaucuga

SEQ ID NO: 62108 - RNA, 1701 nt, Artificial Sequence
  derived and/or modified sequence opt1 from hemagglutinin__InfluenzaA__ABG80128
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccgcaucgaggugacgaacgccaccgagcucguccagagcuccagcaccgggcggaucugcgacagcccccaccgcauccuggacggcaagaacugcacccugaucgacgcccuccugggggacccccacugcgacggcuuccagaacaaggagugggaccuguucguggagcgguccaaggccuacuccaacugcuaccccuacgacgugccggacuacgcgagccuccgcucccuggucgccagcuccggcacgcuggaguucaucaacgaggacuucaacuggaccgggguggcccaggacggcaagagcuacgccugcaagcggggguccgugaacagcuucuucucccgccucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgggccuccgggcgcgucaccgugagcaccaagcggagccagcagaccgugaucccgaacaucggcuuccgccccuggguccgggggcucuccagccgcaucuccaucuacuggacgaucgugaagcccggcgacauccugcugaucaacagcaccgggaaccucaucgcgccccggggcuacuucaagauccgcaacggcaaguccagcaucaugcgguccgacgccccgaucgggaacugcagcuccgagugcaucacccccaacggcagcauccccaacgacaagcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggagcuacaacgccggccugcucguggcccuggagaaccagcacaccaucgaccugacggacuccgagaugaacaagcuguucgagcgcacccggaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaagggcguggagcucaaguccggguacaaggacuggauccuguggaucagcuucgccaucuccugcuuccugcucugcgucgugcugcugggcuucaucaugugggccugccagaaggggaacauccgcugcaacaucugcaucuga

SEQ ID NO: 62109 - RNA, 1701 nt, Artificial Sequence
  derived and/or modified sequence opt1 from hemagglutinin__InfluenzaA__ABG80139
augaagaccaucaucgcccugagcuacauccucugccugguguucgcccagaagcugcccggcaacgacaacuccaccgcgacccucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuacgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccggccugcucguggcccuggagaaccagcacaccaucgaccugacggacagcgagaugaacaagcuguucgagcgcacccgcaagcagcuccgggagaacgccgaggacauggggaacggcugcuucaagaucuaccacaagugcgacaacacgugcaucggguccauccgcaacggcaccuacgaccacgacgucuaccgggacgaggcgcugaacaaccgcuuccagaucaagggcguggagcucaagagcggguacaaggacuggauccuguggaucuccuucgccaucagcugcuuccugcucugcgucgugcugcugggcuucaucaugugggccugccagaaggggaacauccggugcaacaucugcaucuga

SEQ ID NO: 62110 - RNA, 1701 nt, Artificial Sequence
  derived and/or modified sequence opt1 from hemagglutinin__InfluenzaA__ABG80150
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgagaacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagcggcaucuccaucuacuggacgaucgugaagcccggggacauccugcugaucaacagcaccggcaaccucaucgcgccccggggcuacuucaagauccgcaacgggaaguccagcaucaugcgguccgacgccccgaucggcaacugcagcuccgagugcaucacccccaacgggagcauccccaacgacaagcccuuccagaacgugaaccgcaucaccuacggcgccugcccgcgguacgucaagcagaacacgcugaagcuggccaccgggaugcgcaacgugcccgagaagcagacccggggcaucuucggcgccaucgccggguucaucgagaacggcugggaggggaugguggacggcugguacggguuccgccaccagaacuccgagggcaccggccaggccgccgaccucaagagcacgcaggcggccaucgaccagaucaacgggaagcugaaccggcugaucgagaagaccaacgagaaguuccaccagaucgagaaggaguucuccgaggucgagggccgcauccaggaccucgagaaguacguggaggacaccaagaucgaccuguggagcuacaacgccgggcugcucguggcccuggagaaccagcacaccaucgaccugacggacuccgagaugaacaagcuguucgagcggacccgcaagcagcuccgcgagaacgccgaggacaugggcaacgggugcuucaagaucuaccacaagugcgacaacgcgugcaucggcagcauccggaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 62111 - RNA, 1701 nt, Artificial Sequence
  derived and/or modified sequence opt1 from hemagglutinin__InfluenzaA__ABG80161
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcaagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaucaacgaggacuucaacuggaccgggguggcccaggacggcaaguccuacgccugcaagcgcgggagcgugaacuccuucuucagccggcugaacuggcuccacaagcuggaguacaaguaccccgcgcugaacgucaccaugcccaacaacggcaaguucgacaagcucuacaucuggggcgugcaccaccccuccaccgacagcgaccagacgucccuguacgugcaggccagcgggcgcgucaccgugagcaccaagcggucccagcagaccgugaucccgaacaucggcuuccgccccuggguccgggggcugagcucccgcaucagcaucuacuggacgaucgugaagcccggcgacauccuccugaucaacuccaccgggaaccugaucgcgccccggggcuacuucaagauccgcaacggcaagagcuccaucaugcggagcgacgccccgaucgggaacugcuccagcgagugcaucacccccaacggcuccauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggcuucaucgagaacgggugggagggcaugguggacgggugguacggcuuccgccaccagaacagcgaggggaccggccaggccgccgaccugaaguccacgcaggcggccaucgaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccggccugcugguggcccucgagaaccagcacaccaucgaccugacggacagcgagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaagggcguggagcucaagagcggguacaaggacuggauccuguggaucuccuucgccaucagcugcuuccugcugugcgucgugcuccugggcuucaucaugugggccugccagaaggggaacauccgcugcaacaucugcaucuga

SEQ ID NO: 62112 - RNA, 1698 nt, Artificial Sequence
  derived and/or modified sequence opt1 from hemagglutinin__InfluenzaA__ABG80172
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacaacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 62113 - RNA, 1698 nt, Artificial Sequence
  derived and/or modified sequence opt1 from hemagglutinin__InfluenzaA__ABG80183
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucgggggccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucucccgcggcuucggcagcgggaucaucacguccaacgcccccauggacgagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 62114 - RNA, 1701 nt, Artificial Sequence
  derived and/or modified sequence opt1 from hemagglutinin__InfluenzaA__ABG80194
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggaguggaaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcuccaucaucagcaucuacuggaccaucgugaagcccggcgacauccuccugaucaacuccaccggcaaccugaucgcgccccggggguacuucaagauccggagcggcaaguccagcaucaugcgcuccaacgccccgaucgggaagugcaacagcgagugcaucacccccaacggcuccauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacagcgagggcacggggcaggccgcggaccugaaguccacccaggccgccaucaaccagaucaacggcaagcucaaccgccugaucgagaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacggcugcuucaagaucuaccacaagugcgacaacgccugcaucggguccauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 62115 - RNA, 1701 nt, Artificial Sequence
  derived and/or modified sequence opt1 from hemagglutinin__InfluenzaA__ABG80205
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacguggccaugcccaacaacgagaaguucgacaagcuguacaucuggggcguccaccaccccagcaccgacuccgaccagaucagccuguacgcccaggccccggggcgggugacggugagcaccaagcgcucccagcagaccgucauccccaacaucggcagccggcccugggugcgcggcguguccagccggaucuccaucuacuggaccaucgucaagcccggggacauccuccugaucaacugcacgggcaaccugaucgccccgcgcggguacuucaagauccggagcggcaaguccagcaucaugcgcuccgacgcgagcaucggcaagugcaacuccgagugcaucacccccaacgggagcauccccaacgacaagcccuuccagaacgugaaccggaucaccuacggcgccugcccgcgcuacgugaagcagaacacccucaagcuggccacggggaugcggaacguccccgagaagcagacccgcggcaucuucggggccaucgccggcuucaucgagaacggcugggaggggaugguggacggcugguacggguuccggcaccagaacuccgagggcaccgggcaggcggccgaccugaaguccacccaggccgccaucaaccagaucaacggcaagcucaaccgccugaucgagaagacgaacgagaaguuccaccagaucgagaaggaguucuccgagguggagggccggauccaggaccuggagaaguacgucgaggacaccaagaucaaccucuggagcuacaacgccgagcugcugguggcgcucgagaaccagcacaccaucgaccugaccgacuccgagaugaacaagcuguucgagcgcacgaagaagcagcuccgggagaacgccgaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggcgugccagaaggggaacauccgcugcaacaucugcaucuga

SEQ ID NO: 62116 - RNA, 1701 nt, Artificial Sequence
  derived and/or modified sequence opt1 from hemagglutinin__InfluenzaA__ABG80216
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcucccccaccggccgcaucugcgacagcccccaccagauccuggacggggagaacugcacccugaucgacgcccuccugggcgacccccacugcgacggguuccagaacaaggagugggaccuguucguggagcgguccacggccuacagcaacugcuacccguacgacguccccgacuacgcgucccuccgcagccugguggccuccagcggcacccuggaguucaacaacgaguccuucaacuggaccggcguggcccagaacgggaccagcuccgccugcaagcggcgcagcaucaaguccuucuucagccggcucaacuggcugcaccagcugaaguacaaguaccccgcgcucaacgucacgaugcccaacaacgagaaguucgacaagcuguacaucuggggcgugcaccacccguccaccgacagcgaccagaucucccuguacgcccaggcccccgggcgcgugaccgucagcaccaagcggagccagcagacggugauccccaacaucggcucccgccccugggugcgcggggucagcucccggaucagcaucuacuggaccaucgugaagccgggcgacauccuccugaucaacuccaccggcaaccugaucgcgccccggggguacuucaagauccgcagcggcaaguccagcaucaugcgguccaacacccccaucgggaagugcaacagcgagugcaucacgcccaacggcuccaucccgaacgacaagcccuuccagaacgugaaccgcaucaccuacggcgccugcccccgguacgucaagcagaacacccucaagcuggccaccgggaugcgcaacgugcccgagaagcagacgcggggcaucuucggggccaucgccggcuucaucgagaacgggugggagggcaugguggacggcugguacggguuccgccaccagaacagcgagggcaccgggcaggccgccgaccugaaguccacccaggcggccaucaaccagaucaacggcaagcucaaccggcugaucgagaagaccaacgagaaguuccaccagaucgagaaggaguucagcgaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagcggacccgcaagcagcuccgcgagaacgccgaggacaugggcaacggcugcuucaagaucuaccacaagugcgacaacgcgugcaucggguccauccggaacggcacguacgaccacgacgucuaccgcgacgaggcccugaacaaccgguuccagaucaaggggguggagcucaagagcggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 62117 - RNA, 1701 nt, Artificial Sequence; identical to SEQ ID NO: 61648
  derived and/or modified sequence opt1 from hemagglutinin__InfluenzaA__ABG80227

SEQ ID NO: 62118 - RNA, 1701 nt, Artificial Sequence; identical to SEQ ID NO: 61524
  derived and/or modified sequence opt1 from hemagglutinin__InfluenzaA__ABG80238

SEQ ID NO: 62119 - RNA, 1701 nt, Artificial Sequence; identical to SEQ ID NO: 61524
  derived and/or modified sequence opt1 from hemagglutinin__InfluenzaA__ABG80249

SEQ ID NO: 62120 - RNA, 1701 nt, Artificial Sequence; identical to SEQ ID NO: 61524
  derived and/or modified sequence opt1 from hemagglutinin__InfluenzaA__ABG80260

SEQ ID NO: 62121 - RNA, 1701 nt, Artificial Sequence
  derived and/or modified sequence opt1 from hemagglutinin__InfluenzaA__ABG80271
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagagcuccagcaccgggggcaucugcgacagcccccaccagauccucgacggggagaacugcacccugauggacgcccugcucggcgacccccagugcgacggcuuccagaacaagaagugggaccuguucguggagcgcagcaaggccuacuccaacugcuaccccuacgacgucccggacuacgcgagccugcggucccucguggccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucagccuguacgcgcaggccuccggccggaucaccgugagcacgaagcgcagccagcagaccgucaucccgaacaucggcucccggccccgcgugcgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 62122 - RNA, 1701 nt, Artificial Sequence; identical to SEQ ID NO: 61599
  derived and/or modified sequence opt1 from hemagglutinin__InfluenzaA__ABG80282

SEQ ID NO: 62123 - RNA, 1701 nt, Artificial Sequence; identical to SEQ ID NO: 61251
  derived and/or modified sequence opt1 from hemagglutinin__InfluenzaA__ABG80293

SEQ ID NO: 62124 - RNA, 1701 nt, Artificial Sequence
  derived and/or modified sequence opt1 from hemagglutinin__InfluenzaA__ABG80304
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccaacaacgaccagaucaaccuguacgcgcaggccagcggccggaucaccguguccacgaagcgcagccagcagaccgugaucccgaacaucggcagccggccccgcguccgggacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62125 - RNA, 1701 nt, Artificial Sequence
  derived and/or modified sequence opt1 from hemagglutinin__InfluenzaA__ABG80315
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugauccagagcuccagcaccgggggcaucugcgacagcccccaccagauccucgacggggagaacugcacccugaucgacgcccugcucggcgacccccagugcgacggcuuccagaacaagaagugggaccuguucgucgagcgcagcaaggccuacuccaacugcuaccccuacgacgugccggacuacgcgagccugcggucccucguggccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucagccuguacgcgcaggccuccggccggaucaccgucagcacgaagcgcagccagcagaccgugaucccgaacaucggcucccggccccgcgugcgggacauccccagccgcaucuccaucuacuggaccaucgucaagcccggggacaugcugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 62126 - RNA, 1701 nt, Artificial Sequence; identical to SEQ ID NO: 61290
  derived and/or modified sequence opt1 from hemagglutinin__InfluenzaA__ABG80326

SEQ ID NO: 62127 - RNA, 1701 nt, Artificial Sequence; identical to SEQ ID NO: 61290
  derived and/or modified sequence opt1 from hemagglutinin__InfluenzaA__ABG80337

SEQ ID NO: 62128 - RNA, 1701 nt, Artificial Sequence
  derived and/or modified sequence opt1 from hemagglutinin__InfluenzaA__ABG80359
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcgggagcuacgccugcaagcgcggcuccgugaacagcuucuucucccggcucaacuggcugcacaagcuggaguacaaguaccccgcgcucaacgucaccaugcccaacaacgggaaguucgacaagcuguacaucuggggcgugcaccaccccagcaccgacuccgaccagacgagccuguacgugcgcgccuccggccgggucaccgugagcaccaagcgcagccagcagaccgugacgccgaacaucgggucccggcccuggguccgcggccucagcucccggaucagcaucuacuggaccaucgugaagcccggggacauccugcugaucaacuccaccggcaaccucaucgcgccccgcggcuacuucaagauccggaacgggaaguccuccaucaugcgcagcgacgccccgaucggcaacugcuccagcgagugcaucacccccaacggguccauccccagcgacaagcccuuccagaacgugaaccggaucacguacggcgccugcccgcgcuacgucaagcagaacacccugaagcuggccaccgggaugcggaacgugcccgagaagcagacccgcggcaucuucggcgccaucgccggguucaucgagaacggcugggaggggaugguggacggcugguacggguuccggcaccagaacuccgagggcacgggccaggccgccgaccucaagagcacccaggcggccgucgaccagaucaacgggaagcugaaccgccugaucgagcggaccaacgagaaguuccaccagaucgagaaggaguucuccgagguggagggccgcauccaggaccucgagaaguacguggaggacaccaagaucgaccuguggagcuacaacgccgagcugcucgucgcccuggagaaccagcacacgaucgaccugaccgacuccgagaugaacaagcuguucgagaagacccgcaagcagcuccgggagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggcgucgagcucaaguccggguacaaggacuggauccuguggaucagcuucgccaucagcugcuuccugcucugcguggugcugcugggcuucaucaugugggccugccagaaggggaacauccggugcaacaucugcaucuga

SEQ ID NO: 62129 - RNA, 1701 nt, Artificial Sequence
  derived and/or modified sequence opt1 from hemagglutinin__InfluenzaA__ABG80370
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaaguccuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcucccggcccuggguccgcgggcucagcucccggaucagcaucuacuggacgaucgugaagcccggcgacauccugcugaucaacuccaccgggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 62130 - RNA, 1701 nt, Artificial Sequence; identical to SEQ ID NO: 62061
  derived and/or modified sequence opt1 from hemagglutinin__InfluenzaA__ABG80392

SEQ ID NO: 62131 - RNA, 1701 nt, Artificial Sequence; identical to SEQ ID NO: 62061
  derived and/or modified sequence opt1 from hemagglutinin__InfluenzaA__ABG80403

SEQ ID NO: 62132 - RNA, 1701 nt, Artificial Sequence; identical to SEQ ID NO: 62061
  derived and/or modified sequence opt1 from hemagglutinin__InfluenzaA__ABG80414

SEQ ID NO: 62133 - RNA, 1701 nt, Artificial Sequence; identical to SEQ ID NO: 62061
  derived and/or modified sequence opt1 from hemagglutinin__InfluenzaA__ABG80425

SEQ ID NO: 62134 - RNA, 1701 nt, Artificial Sequence; identical to SEQ ID NO: 61791
  derived and/or modified sequence opt1 from hemagglutinin__InfluenzaA__ABG88289

SEQ ID NO: 62135 - RNA, 1701 nt, Artificial Sequence
  derived and/or modified sequence opt1 from hemagglutinin__InfluenzaA__ABG88300
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccgaccucagcaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucaccaagcgccccaaggugcgggaccaggagggccgcaucaacuacuacuggacgcuccuggagcccggcgacaccaucaucuucgaggccaacgggaaccugaucgcccccugguacgccuucgcccucagccggggcuucggguccggcaucaucaccagcaacgcguccaugggcgagugcgacgccaagugccagaccccgcagggggccaucaacagcucccugcccuuccagaacgugcaccccgucacgaucggcgagugccccaaguacgugcgcagcaccaagcugcggauggugaccgggcuccgcaacaucccguccauccagagccggggccuguucggggccaucgccggcuucaucgagggcggguggaccggcaugaucgacgggugguacggcuaccaccaccagaacgagcagggguccggcuacgcggccgaccagaaguccacgcagaacgccaucgacggcaucaccaacaaggucaacagcgugaucgagaagaugaacacccaguucaccgccguggggaaggaguucaacaagcuggagcgccggauggagaaccucaacaagaaggucgacgacggcuuccuggacaucuggacguacaacgccgagcugcucgugcugcuggagaacgagcgcacccucgacuuccacgacagcaacgucaagaaccuguacgagaaggugaagacccagcugaagaacaacgcgaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacagcacgguggccuccagccucguccugcuggugucccucggggccaucagcuucuggaugugcuccaacggcagccugcagugccgcaucugcaucuga

SEQ ID NO: 62136 - RNA, 1701 nt, Artificial Sequence; identical to SEQ ID NO: 61919
  derived and/or modified sequence opt1 from hemagglutinin__InfluenzaA__ABG88311

SEQ ID NO: 62137 - RNA, 1701 nt, Artificial Sequence
  derived and/or modified sequence opt1 from hemagglutinin__InfluenzaA__ABG88322
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccauccucagcaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucagccggggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcgcagcacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgaccagaaguccacccagaacgccaucgacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacagcaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacagcaccguggccuccagccucguccugcuggugucccucggggccaucagcuucuggaugugcuccaacggcagccugcagugccgcaucugcaucuga

SEQ ID NO: 62138 - RNA, 1701 nt, Artificial Sequence
  derived and/or modified sequence opt1 from hemagglutinin__InfluenzaA__ABG88333
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagagcuccuggccgaagcacaacgucacccggggcgugacggccagcugcucccacaagggcaagagcuccuucuaccgcaaccuccuguggcugaccgagaagaacgggagcuaccccaaccucagcaaguccuacgugaacaacaaggagaaggagguccuggugcuguggggcgugcaccaccccagcaacaucgaggaccagaagaccaucuaccggaaggagaacgccuacgucuccguggugagcucccacuacaaccgccgguucacccccgagaucagcaagcgcccgaagguccgggggcaggagggccgcaucaacuacuacuggacgcuccuggagcccggcgacaccaucaucuucgaggcgaacgggaaccugaucgcccccugguacgccuucgcccucucccggggcuucgggagcggcaucaucaccuccaacgccagcauggacgagugcgacgcgaagugccagacgccccagggcgccaucaacuccagccugccguuccagaacgugcaccccgugaccaucggggagugccccaaguacguccgcuccaccaagcugcggauggugaccggccuccgcaacauccccagcauccagucccgggggcuguucggcgccaucgccggguucaucgagggcggcuggaccgggaugaucgacggcugguacggguaccaccaccagaacgagcagggcagcggguacgccgcggaccagaaguccacgcagaacgccaucaacggcaucaccaacaaggugaacagcgucaucgagaagaugaacacccaguucaccgccgugggcaaggaguucaacaagcuggagaagcgcauggagaaccucaacaagaagguggacgacggguuccuggacaucuggacguacaacgccgagcugcucguccugcuggagaacgagcggacccucgacuuccacgacuccaacgugaagaaccuguacgagaaggucaagagccagcugaagaacaacgccaaggagaucggcaacgggugcuucgaguucuaccacaagugcaacaacgagugcauggagagcgugaagaacggcaccuacgacuacccgaaguacuccgaggagagcaagcucaaccgcgagaagaucgacggggugaagcuggaguccaugggcgucuaccagauccuggcgaucuacagcaccguggccuccagccucgugcugcuggucucccucggcgccaucagcuucuggaugugcuccaacgggagccugcagugccggaucugcaucuga

SEQ ID NO: 62139 - RNA, 1701 nt, Artificial Sequence
  derived and/or modified sequence opt1 from hemagglutinin__InfluenzaA__ABG88344
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagagcuccuggccgaagcacaacgucacccgcggggugacggccagcugcucccacaagggcaagagcuccuucuaccggaaccuccuguggcugaccgagaagaacgggagcuaccccaaccucagcaaguccuacgugaacaacaaggagaaggagguccuggugcuguggggcgugcaccaccccagcaacaucgaggaccagaagaccaucuaccggaaggagaacgccuacgucuccguggugagcucccacuacaaccgccgguucacccccgagaucagcaagcgcccgaagguccggaaccaggaggggcgcaucaacuacuacuggacgcuccuggagcccggcgacaccaucaucuucgaggcgaacggcaaccugaucgcccccugguacgccuucgcccucucccggggguucggcagcgggaucaucaccuccaacgccagcauggacgagugcgacgcgaagugccagacgccccagggcgccaucaacuccagccugccguuccagaacgugcaccccgugaccaucggcgagugccccaaguacguccgcuccaccaagcugcggauggugaccgggcuccgcaacauccccagcauccagucccggggccuguucggggccaucgccggcuucaucgagggcggcuggaccggcaugaucgacgggugguacggcuaccaccaccagaacgagcaggggagcggcuacgccgcggaccagaaguccacgcagaacgccaucaacgggaucaccaacaaggugaacagcgucaucgagaagaugaacacccaguucaccgccgugggcaaggaguucaacaagcuggagaagcgcauggagaaccucaacaagaagguggacgacggcuuccuggacaucuggacguacaacgccgagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacaacgagugcauggagagcgugaagaacgggaccuacgacuacccgaaguacuccgaggagagcaagcucaaccgcgagaagaucgacggcgugaagcuggaguccaugggggucuaccagauccuggcgaucuacagcaccguggccuccagccucgugcugcuggucucccucggcgccaucagcuucuggaugugcuccaacggcagccugcagugccggaucugcaucuga

SEQ ID NO: 62140 - RNA, 1701 nt, Artificial Sequence
  derived and/or modified sequence opt1 from hemagglutinin__InfluenzaA__ABG88355
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggagccuggucgccuccagcggcacgcuggaguucaccaacgagaacuucaacuggaccgggguggcccaggacggcaaguccuacgccugcaagcgcgggagcgugaacuccuucuucagccggcucaacuggcugcacaagcuggaguacaaguaccccgcgcucaacgucaccaugcccaacaacggcaaguucgacaagcuguacaucuggggcgugcaccacccguccacggacagcgaccagaccucccuguacgugcgcgccagcgggaaggucaccguguccaccaagcggagccagcagacggugauccccgacaucggcuaccgccccuggguccgggggcucagcucccgcaucagcaucuacuggaccaucgugaagcccggcgacauccugcugaucaacuccaccgggaaccucaucgccccgcggggcuacuucaagauccgcaacggcgagagcuccaucaugcggagcgacgcccccaucgggaacugcuccagcgagugcaucacccccaacggcuccauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacagcgaggggacgggccaggccgccgaccucaaguccacccaggcggccaucgaccagaucaacggcaagcugaaccggcuggucgagaagaccaacgagaaguuccaccagaucgagaaggaguucagcgagguggaggggcgcauccaggaccucgagaaguacguggaggacaccaagaucgaccugugguccuacaacgccgagcugcucgucgcccuggagaaccagcacacgaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggaccuacgaccacgacguguaccgcgacgaggcccugaacaaccgguuccagaucaagggcgucgagcucaagagcggcuacaaggacuggauccuguggaucuccuucgccaucagcugcuuccugcucugcguggugcugcugggguucaucaugugggccugccagaagggcaacauccgcugcaacaucugcaucuga

SEQ ID NO: 62141 - RNA, 1701 nt, Artificial Sequence
  derived and/or modified sequence opt1 from hemagglutinin__InfluenzaA__ABG88366
augaagaccaucaucgcccugagcuacuuccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuacccguacgacgugcccgacuacgcgagccuccggucccuggucgccagcuccggcacgcuggaguucaccaacgagaacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccacccgagcacggacuccgaccagaccagccuguacgugcgcgccuccgggaaggucaccgugagcaccaagcggucccagcagacggugauccccgacaucggcuaccgccccuggguccgggggcucagcagccgcaucuccaucuacuggaccaucgugaagcccggcgacauccugcugaucaacagcaccgggaaccucaucgccccgcggggcuacuucaagauccgcaacggcaaguccagcaucaugcgguccgacgcccccaucgggaacugcagcuccgagugcaucacccccaacggcagcauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagagcacccaggcggccaucgaccagaucaacggcaagcugaaccggcuggucgagaagaccaacgagaaguuccaccagaucgagaaggaguucuccgagguggaggggcgcauccaggaccucgagaaguacguggaggacaccaagaucgaccuguggagcuacaacgccgagcugcucgucgcccuggagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcgucgagcucaaguccggcuacaaggacuggauccuguggaucagcuucgccaucuccugcuuccugcucugcguggugcugcugggguucaucaugugggccugccagaagggcaacauccgcugcaacaucugcaucuga

SEQ ID NO: 62142 - RNA, 1701 nt, Artificial Sequence; identical to SEQ ID NO: 61992
  derived and/or modified sequence opt1 from hemagglutinin__InfluenzaA__ABG88377

SEQ ID NO: 62143 - RNA, 1701 nt, Artificial Sequence; identical to SEQ ID NO: 61992
  derived and/or modified sequence opt1 from hemagglutinin__InfluenzaA__ABG88388

SEQ ID NO: 62144 - RNA, 1701 nt, Artificial Sequence
  derived and/or modified sequence opt1 from hemagglutinin__InfluenzaA__ABG88399
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaaggagagcuucaacuggaccgggguggcccaggacggcaaguccuacgccugcaagcgcgggagcgugaacuccuucuucagccggcucaacuggcugcacaagcuggaguacaaguaccccgcgcucaacgucaccaugcccaacaacgacaaguucgacaagcuguacaucuggggcgugcaccaccccuccacggacagcgaccagaccucccuguacgugcaggccagcgggcgcgucaccgugagcaccaagcggucccagcagacggugaucccgaacaucggcagccgccccuggguccggggcaucuccagccgcaucuccaucuacuggaccaucgugaagcccggggacauccuccugaucaacagcaccggcaaccugaucgcgccccggggguacuucaagauccgcaacggcaaguccagcaucaugcgguccgacgccccgaucggcaacugcaacagcgagugcaucacccccaacggguccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacggcugggaggggaugguggacggcugguacggguuccgccaccagaacagcgagggcacggggcaggccgccgaccugaaguccacccaggcggccaucgaccagaucaacggcaagcucaaccggcugaucgagaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcgucgugcuccugggcuucaucaugugggccugccagaaggggaacauccgcugcaacaucugcaucuga

SEQ ID NO: 62145 - RNA, 1701 nt, Artificial Sequence; identical to SEQ ID NO: 62032
  derived and/or modified sequence opt1 from hemagglutinin__InfluenzaA__ABG88410

SEQ ID NO: 62146 - RNA, 1701 nt, Artificial Sequence; identical to SEQ ID NO: 62032
  derived and/or modified sequence opt1 from hemagglutinin__InfluenzaA__ABG88421

SEQ ID NO: 62147 - RNA, 1701 nt, Artificial Sequence
  derived and/or modified sequence opt1 from hemagglutinin__InfluenzaA__ABG88432
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagaugcggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 62148 - RNA, 1701 nt, Artificial Sequence; identical to SEQ ID NO: 62032
  derived and/or modified sequence opt1 from hemagglutinin__InfluenzaA__ABG88443

SEQ ID NO: 62149 - RNA, 1701 nt, Artificial Sequence
  derived and/or modified sequence opt1 from hemagglutinin__InfluenzaA__ABG88454
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgcgaacagcuucuucucccggcucaacuggcugcacaagcuggaguacaaguaccccgcccucaacgugaccaugcccaacaacggcaaguucgacaagcuguacaucuggggcguccaccaccccagcaccgacuccgaccagacgagccuguacgugcgcgccuccgggggcgugaccgucagcaccaagcggagccagcagaccgugaucccgaacaucgggucccgccccugggugcggggccucagcucccgcaucagcaucuacuggacgaucgucaagcccggggacauccugcugaucaacuccaccggcaaccucaucgcgccccggggcuacuucaagauccgcagcgggaaguccagcaucaugcgguccgacgccagcaucggcaacugcuccagcgagugcaucaccccgaacggguccauccccaacgacaagcccuuccagaacgugaaccgcaucaccuacggcgccugcccccgguacgugaagcagaacacgcugaagcuggccaccgggaugcgcaacgucccggagaagcagacccggggcaucuucggcgccaucgccggguucaucgagaacggcugggaggggaugguggacggcugguacggguuccgccaccagaacagcgagggcaccggccaggccgcggaccucaaguccacgcaggccgccaucgaccagaucaacgggaagcugaaccggcugaucggcaagaccaacgacaaguuccaccagaucgagaaggaguucagcgagguggaggggcgcauccaggaccucgagaaguacgucgaggacaccaagaucgaccugugguccuacaacgccgagcugcucguggcccuggagaaccagcacaccaucgaccugacggacagcgagaugaacaagcuguucgagcggacccgcaagcagcuccgcgagaacgcggaggacaugggcaacgggugcuucaagaucuaccacaagugcgacaacgccugcaucggcuccauccggaacggcaccuacgaccacgacguguaccgcgacgaggcccugaacaaccgguuccagaucaagggggucgagcucaagagcggcuacaaggacuggauccuguggaucagcuucgccaucuccugcuuccugcucugcgugguccugcugggguucaucaugugggccugccagaagggcaacauccgcugcaacaucugcaucuga

SEQ ID NO: 62150 - RNA, 1701 nt, Artificial Sequence
  derived and/or modified sequence opt1 from hemagglutinin__InfluenzaA__ABG88465
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacauccccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgagguggaggggcggauccaggaccucgagaaguacgucgaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggcgucgagcucaaguccggguacaaggacuggauccuguggaucagcuucgccaucuccugcuuccugcucugcgugguccugcugggcuucaucaugugggccugccagaaggggaacauccggugcaacaucugcaucuga

SEQ ID NO: 62151 - RNA, 1701 nt, Artificial Sequence; identical to SEQ ID NO: 62032
  derived and/or modified sequence opt1 from hemagglutinin__InfluenzaA__ABG88476

SEQ ID NO: 62152 - RNA, 1701 nt, Artificial Sequence; identical to SEQ ID NO: 62032
  derived and/or modified sequence opt1 from hemagglutinin__InfluenzaA__ABG88487

SEQ ID NO: 62153 - RNA, 1701 nt, Artificial Sequence; identical to SEQ ID NO: 62032
  derived and/or modified sequence opt1 from hemagglutinin__InfluenzaA__ABG88498

SEQ ID NO: 62154 - RNA, 1701 nt, Artificial Sequence; identical to SEQ ID NO: 62032
  derived and/or modified sequence opt1 from hemagglutinin__InfluenzaA__ABG88509

SEQ ID NO: 62155 - RNA, 1701 nt, Artificial Sequence
  derived and/or modified sequence opt1 from hemagglutinin__InfluenzaA__ABG88520
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcaagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaucaacgaggacuucaacuggaccgggguggcccaggacggcaaguccuacgccugcaagcgcgggagcgugaacuccuucuucagccggcugaacuggcuccacaagcuggaguacaaguaccccgcgcugaacgucaccaugcccaacaacggcaaguucgacaagcucuacaucuggggcgugcaccaccccuccaccgacagcgaccagacgucccuguacgugcgcgccagcgggcgggucaccgugagcaccaagcgcucccagcagaccgugaucccgaacaucggcuuccggcccuggguccgcgggcugagcucccggaucagcaucuacuggacgaucgugaagcccggcgacauccuccugaucaacuccaccgggaaccugaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccugaaguccacgcaggcggccaucgaccagaucaacggcaagcucaaccgccugaucgagaagaccaacgagaaguuccaccagaucgagaaggaguucagcgaggucgaggggcggauccaggaccuggagaaguacguggaggacaccaagaucgaccucugguccuacaacgccggccugcugguggcccucgagaaccagcacaccaucgaccugacggacagcgagaugaacaagcuguucgagcgcacccgcaagcagcuccgggagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaagggcguggagcucaagagcggguacaaggacuggauccuguggaucuccuucgccaucagcugcuuccugcugugcgucgugcuccugggcuucaccaugugggccugccagaaggggaacauccggugcaacaucugcaucuga

SEQ ID NO: 62156 - RNA, 1701 nt, Artificial Sequence
  derived and/or modified sequence opt1 from hemagglutinin__InfluenzaA__ABG88531
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgugcagacgagccuguacguccgcgccuccgggcgggugaccgugagcaccaagcgcagccagcagaccgucaucccgaacaucggcuuccggcccugggugcgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgucaaccggaucaccuacggggccugcccgcgcuacgugaagcagaacacgcugaagcuggccaccggcaugcggaacgugcccgagaagcagacccgcgggaucuucggcgccaucgccggcuucaucgagaacgggugggagggcauggucgacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgagguggaggggcggauccaggaccucgagaaguacguggaggacaccaagaucgaccuguggagcuacaacgccggccugcucgucgcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggcgucgagcucaaguccggguacaaggacuggauccuguggaucagcuucgccaucuccugcuuccugcucugcguggugcugcugggcuucaucaugugggccugccagaaggggaacauccggugcaacaucugcaucuga

SEQ ID NO: 62157 - RNA, 1698 nt, Artificial Sequence; identical to SEQ ID NO: 62043
  derived and/or modified sequence opt1 from hemagglutinin__InfluenzaA__ABG88553

SEQ ID NO: 62158 - RNA, 1701 nt, Artificial Sequence; identical to SEQ ID NO: 61718
  derived and/or modified sequence opt1 from hemagglutinin__InfluenzaA__ABG88564

SEQ ID NO: 62159 - RNA, 1701 nt, Artificial Sequence; identical to SEQ ID NO: 61748
  derived and/or modified sequence opt1 from hemagglutinin__InfluenzaA__ABG88575

SEQ ID NO: 62160 - RNA, 1701 nt, Artificial Sequence; identical to SEQ ID NO: 61658
  derived and/or modified sequence opt1 from hemagglutinin__InfluenzaA__ABG88586

SEQ ID NO: 62161 - RNA, 1701 nt, Artificial Sequence
  derived and/or modified sequence opt1 from hemagglutinin__InfluenzaA__ABG88597
augaagaccaucaucgcccugagcuacauccucugccugguguucgcccagaagcugcccgcgaacgacaacuccaccgccacgcucugccugggccaccacgccgucccgaacgggacccuggugaagaccaucaccaacgacaacaucgaggugacgaacgccaccgagcucguccagagcuccagcaccggccgcaucugcgacagcccccaccagauccuggacggggagaacugcacccugaucgacgcccuccugggcgacccccacugcgacggguuccagaacaaggagugggaccuguucguggagcggagcacggcguacuccaacugcuaccccuacgacgugccggacuacgccagccuccgcucccuggucgccagcuccggcacccuggaguucaacaacgagagcuucaacuggaccggcguggaccagaacgggaccuccagcgccugcaagcggcgcuccaacaagagcuucuucucccggcucaacuggcugcaccagcugaaguacaaguaccccgcgcucaacgugacgaugcccaacaacgagaaguucgacaagcuguacaucuggggcguccaccaccccagcaccgacuccgaccagaucagccuguacgcccaggccagcgggcgcgugaccguguccaccaagcggagccagcagacggucaucccgaacaucggcucccgccccugggugcgcggggugagcucccggaucagcaucuacuggaccaucgucaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgugaagcagaacacccucaagcuggccaccgggaugcgcaacguccccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggguucaucaugugggccugccagaagggcaacauccgcugcaacaucugcaucuga

SEQ ID NO: 62162 - RNA, 1701 nt, Artificial Sequence
  derived and/or modified sequence opt1 from hemagglutinin__InfluenzaA__ABG88608
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagccgcgccuacuccaacugcuaccccuacgacgugccggacuacgucagccuccggucccugguggcgagcuccggcacgcuggaguucaacaacgagagcuucaacuggaccgggguggcccagaacggcaccuccagcgccugcaagcgccgguccgacaagagcuucuucucccgccucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgggugaccgucagcaccaagcgcucccagcagaccgugaucccgaacaucggcagccggcccugggugcgcggcgucuccagccggaucuccaucuacuggacgaucgugaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggccgcgaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgcgagaacgccgaggacauggggaacggcugcuucaagaucuaccacaagugcgacaacgccugcaucgggagcauccggaacggcaccuacgaccacgacguguaccgcgacgaggcgcugaacacccgguuccagaucaagggggucgagcugaaguccggcuacaaggacuggauccucuggaucagcuucgccaucagcugcuuccugcugugcaucgugcuccugggcuucaucaugugggccugccagaaggggaacauccgcugcaacaucugcaucuga

SEQ ID NO: 62163 - RNA, 1701 nt, Artificial Sequence; identical to SEQ ID NO: 61570
  derived and/or modified sequence opt1 from hemagglutinin__InfluenzaA__ABG88619

SEQ ID NO: 62164 - RNA, 1701 nt, Artificial Sequence
  derived and/or modified sequence opt1 from hemagglutinin__InfluenzaA__ABG88630
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccaggugcuggacggcgagaacugcacccugaucgacgcccuccugggggacccccacugcgacggcuuccagaacaaggagugggaccuguucguggagcggagcaaggccuacuccaacugcuaccccuacgacgucccggacuacgugagccuccgcucccugguggcgagcuccggcacgcuggaguucaacaacgagagcuucaacuggaccggggucgcccagaacggcaccuccagcgccugcaagcggcgcuccgacaagagcuucuucucccggcucaacuggcugcaccagcugaaguacaaguaccccgcccucaacgugaccaugcccaacaacgagaaguucgacaagcuguacaucuggggcgugcaccaccccgggacggacagcgaccagaucucccuguacgcgcaggccagcgggcgcgucaccgugagcaccaagcggucccagcagaccgugaucccgaacaucggcagccgccccuggguccggggcguguccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaaccgcaucaccuacggcgccugcccgcgguacgugaagcagaagacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcugaaguccggcuacaaggacuggauccucuggaucagcuucgccaucagcugcuuccugcugugcaucguccuccugggcuucaucaugugggccugccagaaggggaacauccggugcaacaucugcaucuga

SEQ ID NO: 62165 - RNA, 1701 nt, Artificial Sequence
  derived and/or modified sequence opt1 from hemagglutinin__InfluenzaA__ABG88641
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccagcggccgcgugaccgucuccaccaagcggagccagcagaccgugaucccgaacaucggguccggccccugggugcgcggcgucagcucccggaucagcaucuacuggacgaucgugaagcccggggacauccuccugaucaacuccaccggcaaccugaucgcgccccgcggguacuucaagauccggagcggcaaguccagcaucaugcgcuccgacgccccgaucggcaagugcaacagcgagugcaucacccccaacggguccauccccaacggcaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggcuucaucgagaacgggugggagggcaugauggacgggugguacggcuuccggcaccagaacagcgaggggaccggccaggccgccgaccugaaguccacgcaggcggccaucaaccagaucaacggcaagcucaaccgccugaucgagaagaccaacgagaaguuccaccagaucgagaaggaguucagcgagguggaggggcggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgccgaggacaugggcaacgggugcuucaagaucuaccacaagugcgacaacgcgugcaucggcuccauccgcaacgggaccuacgaccacgacguguaccgcgacgaggcccugaacaaccgguuccagaucaagggcgucgagcucaagagcggcuacaaggacuggauccuguggaucagcuucgccaccuccugcuuccugcugugcaucgugcuccugggguucaucaugugggccugccagaagggcaacauccgcugcaacaucugcaucuga

SEQ ID NO: 62166 - RNA, 1701 nt, Artificial Sequence; identical to SEQ ID NO: 61524
  derived and/or modified sequence opt1 from hemagglutinin__InfluenzaA__ABG88652

SEQ ID NO: 62167 - RNA, 1701 nt, Artificial Sequence; identical to SEQ ID NO: 61524
  derived and/or modified sequence opt1 from hemagglutinin__InfluenzaA__ABG88663

SEQ ID NO: 62168 - RNA, 1701 nt, Artificial Sequence; identical to SEQ ID NO: 61524
  derived and/or modified sequence opt1 from hemagglutinin__InfluenzaA__ABG88674

SEQ ID NO: 62169 - RNA, 1701 nt, Artificial Sequence; identical to SEQ ID NO: 61524
  derived and/or modified sequence opt1 from hemagglutinin__InfluenzaA__ABG88685

SEQ ID NO: 62170 - RNA, 1701 nt, Artificial Sequence; identical to SEQ ID NO: 61524
  derived and/or modified sequence opt1 from hemagglutinin__InfluenzaA__ABG88696

SEQ ID NO: 62171 - RNA, 1701 nt, Artificial Sequence; identical to SEQ ID NO: 61290
  derived and/or modified sequence opt1 from hemagglutinin__InfluenzaA__ABG88707

SEQ ID NO: 62172 - RNA, 1701 nt, Artificial Sequence; identical to SEQ ID NO: 61290
  derived and/or modified sequence opt1 from hemagglutinin__InfluenzaA__ABG88718

SEQ ID NO: 62173 - RNA, 1701 nt, Artificial Sequence
  derived and/or modified sequence opt1 from hemagglutinin__InfluenzaA__ABG88729
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcgggagcuacgccugcaagcgcggcuccgugaacagcuucuucucccggcucaacuggcugcacaagcuggaguacaaguaccccgcgcucaacgucaccaugcccaacagcgggaaguucgacaagcuguacaucuggggcgugcaccaccccuccaccgacagcgaccagacgucccuguacgugcgcgccagcggccgggucaccgugagcaccaagcgcucccagcagaccgugacgccgaacaucgggagccggcccuggguccgcggccucuccagccggaucuccaucuacuggaccaucgugaagcccggggacauccugcugaucaacagcaccggcaaccucaucgcgccccgcggcuacuucaagauccggaacgggaaguccagcaucaugcgcuccgacgccccgaucggcaacugcagcuccgagugcaucacccccaacgggagcauccccaacgacaagcccuuccagaacgugaaccggaucacguacggcgccugcccgcgcuacgucaagcagaacacccugaagcuggccaccgggaugcggaacgugcccgagaagcagacccgcggcaucuucggcgccaucgccggguucaucgagaacggcugggaggggaugguggacggcugguacggguuccggcaccagaacuccgagggcacgggccaggccgccgaccucaagagcacccaggcggccaucgaccagaucaacgggaagcugaaccgccugaucgagaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagaagacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaagggcguggagcucaaguccggguacaaggacuggauccuguggaucagcuucgccaucagcugcuuccugcucugcgucgugcugcugggcuucaucaugugggccugccagaaggggaacauccgcugcaacaucugcaucuga

SEQ ID NO: 62174 - RNA, 1701 nt, Artificial Sequence
  derived and/or modified sequence opt1 from hemagglutinin__InfluenzaA__ABG88740
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcucccggcccuggguccgcgggcucagcucccggaucagcaucuacuggacgaucgugaagcccggcgacauccugcugaucaacuccaccgggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacaucaagcagaacacgcugaagcuggccaccggcaugcggaacguccccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccugaucgagaagaccaacgagaaguuccaccagaucgagaaggaguucagcgagguggaggggcggauccaggaccucgagaaguacgucgaggacaccaagaucgaccugugguccuacaacgccgagcugcucguggcccuggagaaccagcacaccaucgaccugacggacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcucugcgugguccugcugggguucaucaugugggccugccagaagggcaacauccggugcaacaucugcaucuga

SEQ ID NO: 62175 - RNA, 1701 nt, Artificial Sequence; identical to SEQ ID NO: 62061
  derived and/or modified sequence opt1 from hemagglutinin__InfluenzaA__ABG88751

SEQ ID NO: 62176 - RNA, 1701 nt, Artificial Sequence
  derived and/or modified sequence opt1 from hemagglutinin__InfluenzaA__ABG88762
augaagaccaucaucgcccugagcuacauccucugccugguguucacccagaagcugcccggcaacgacaacuccacggccacccucugccuggggcaccacgcggucccgaacggcacccuggugaagaccaucacgaacgaccagaucgaggugaccaacgccaccgagcucguccagagcuccagcaccgggcgcaucugcgacagcccccaccggauccuggacggcaagaacugcacgcugaucgacgcccuccugggggacccccacugcgacggcuuccagaacaaggagugggaccuguucguggagcgcagcaaggccuacuccaacugcuaccccuacgacgugccggacuacgccagccuccggucccuggucgcgagcuccggcacccuggaguucaucaacgaggacuucaacuggaccgggguggcccaggacggcgggagcuacgccugcaagcgcggcuccgugaacagcuucuucucccggcucaacuggcugcacaagcuggaguacaaguaccccgcccucaacgucaccaugcccaacaacgggaaguucgacaagcuguacaucuggggcgugcaccaccccagcacggacuccgaccagaccagccuguacgugcgcgcguccggccgggucaccgugagcaccaagcgcagccagcagacggugaucccgaacaucgggucccggcccuggguccgcggccucagcucccggaucagcaucuacuggaccaucgugaagcccggggacauccugcugaucaacuccaccggcaaccucaucgcgccccgcggcuacuucaagauccggaacgggaaguccuccaucaugcgcagcgacgccuccaucggcaacugcagcuccgagugcaucaccccgaacgggagcauccccaacgacaagcccuuccagaacgugaaccggaucacguacggcgccugcccccgcuacgucaagcagaacacccugaagcuggccaccgggaugcggaacgugccggagaagcagacccgcggcaucuucggcgccaucgccggguucaucgagaacggcugggaggggaugguggacggcugguacggguuccggcaccagaacuccgagggcacgggccaggccgccgaccucaagagcacccaggccgcgaucgaccagaucaacgggaagcugaaccgccugaucgagaagaccaacgagaaguuccaccagaucgagaaggaggucuccgagguggagggccggauccaggaccucgagaaguacguggaggacaccaagaucgaccuguggagcuacaacgccgagcugcucgucgcccuggagaaccagcacacgaucgaccugaccgacuccgagaugaacaagcuguucgagcgcacccgcaagcagcuccgggagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaaguccgucgagcucaagagcggcuacaaggacuggauccuguggaucagcuucgccaucuccugcuuccugcucugcguggugcugcugggguucaucaugugggccugccagaagggcaacauccggugcaacaucugcaucuga

SEQ ID NO: 62177 - RNA, 1701 nt, Artificial Sequence
  derived and/or modified sequence opt1 from hemagglutinin__InfluenzaA__ABG88773
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcgccgggcgcaucugcgacagcccccaccggauccuggacggcaagaacugcacccugaucgacgcccuccugggggacccccacugcgacggcuuccagaacaaggagugggaccuguucguggagcgcuccaaggcguacuccaacugcuaccccuacgacgugccggacuacgccagccuccggucccuggucgccagcuccggcacccuggaguucaucaacgaggacuucaacuggacggggguggcccaggacggcaagagcuacgcgugcaagcgcggguccgugaacagcuucuucucccggcucaacuggcugcacaagcuggaguacaaguaccccgcccucaacgucaccaugcccaacaacggcaaguucgacaagcuguacaucuggggcgugcaccaccccagcaccgacuccgaccagaccagccuguacgugcgcgccuccgggcgggucacggugagcaccaagcgcagccagcagaccgugaucccgaacaucggcucccggcccuggguccgcgggcucagcucccggaucagcaucuacuggaccaucgugaagcccggcgacauccugcugaucaacuccacggggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacgucaagcagaacacccugaagcuggccacgggcaugcggaacgugcccgagaagcagacccgcgggaucuucggcgccaucgccggcuucaucgagaacgggugggagggcaugguggacgggugguacggcuuccggcaccagaacagcgaggggaccggccaggccgcggaccucaaguccacccaggccgccacggaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacagcgagaugaacaagcuguucgagcgcacccgcaagcagcuccgggagaacgcggaggacaugggcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 62178 - RNA, 1701 nt, Artificial Sequence
  derived and/or modified sequence opt1 from hemagglutinin__InfluenzaA__ABG88784
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcucccggcccuggguccgcgggcucagcucccggaucagcaucuacuggacgaucgugaagcccggcgacauccugcugaucaacuccaccgggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccugaucaagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 62179 - RNA, 1701 nt, Artificial Sequence
  derived and/or modified sequence opt1 from hemagglutinin__InfluenzaA__ABG88806
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccgugcccaacaacgagaaguucgacaagcuguacaucuggggcgugcaccaccccgggacggacagcgaccagaucucccuguacgcgcaggccagcgggcgcgucaccgugagcaccaagcggucccagcagaccgugaucccgaacaucggcagccgccccuggguccggggcguguccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaaccgcaucaccuacggcgccugcccgcgguacgugaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcugaaguccggcuacaaggacuggauccucuggaucagcuucgccaucagcugcuuccugcugugcaucguccuccugggcuucaucaugugggccugccagaaggggaacauccggugcaacaucugcaucuga

SEQ ID NO: 62180 - RNA, 1704 nt, Artificial Sequence
  derived and/or modified sequence opt1 from hemagglutinin__InfluenzaA__ABI16504
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucaucagcaaguccagcugguccgaccacgaggccagcuccggcgucagcuccgcgugcccguaccagggcacccccagcuucuuccgcaacgugguguggcugaucaagaagaacaacacguaccccaccaucaagcgguccuacaacaacaccaaccaggaggaccuccugauccugugggggauccaccacagcaacaacgccgccgagcagaccaagcucuaccagaaccccacgaccuacaucuccgucggcaccagcacccugaaccugcgccucgugccgaagaucgccacgcgguccaaggugaacgggcagagcggccgcauggacuucuucuggaccauccugaagcccaacgacgcgaucaacuucgagagcaacgggaacuucaucgcccccgaguacgccuacaagaucgucaagaagggcgacuccgccaucaugaaguccgagguggaguacggcaacugcaacaccaagugccagacccccaucggggccaucaacagcagcaugccguuccacaacauccacccccugacgaucggcgagugccccaaguacgugaaguccaacaagcucguccuggcgaccgggcugcggaacagcccccuccgcgagcggcgccggaagcgcggccuguucggcgccaucgccggguucaucgagggcggguggcagggcaugguggacgggugguacggcuaccaccacuccaacgagcagggcagcggguacgccgccgacaaggaguccacccagaaggcgaucgacggcgugaccaacaaggucaacagcaucaucgacaagaugaacacgcaguucgaggccguggggcgggaguucaacaaccuggagcgccggaucgagaaccucaacaagaagauggaggacggcuuccuggacguguggaccuacaacgccgagcugcucguccugauggagaacgagcgcacccuggacuuccacgacuccaacgugaagaaccucuacgacaagguccggcugcagcugcgcgacaacgccaaggagcucgggaacggcugcuucgaguucuaccacaagugcgacaacgagugcauggagagcgugcggaacggcaccuacgacuacccgcaguacuccgaggaggcccgccugaagcgggaggagaucagcggggugaagcuggaguccaucggcacguaccagauccucagcaucuacuccaccgucgcgagcucccuggcccuggccaucaugguggccgggcucagccuguggaugugcagcaacggcucccugcagugccgcaucugcaucuga

SEQ ID NO: 62181 - RNA, 1701 nt, Artificial Sequence; identical to SEQ ID NO: 61641
  derived and/or modified sequence opt1 from hemagglutinin__InfluenzaA__ABI20793

SEQ ID NO: 62182 - RNA, 1701 nt, Artificial Sequence
  derived and/or modified sequence opt1 from hemagglutinin__InfluenzaA__ABI20837
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucagccggggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcgcagcacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgaccagaaguccacccagaacgccaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacagcaacgucaagaaccuguacgagaaggugaagacccagcugaagaacaacgccaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacagcaccguggccuccagccucguccugcuggugucccucggggccaucagcuucuggaugugcuccaacggcagccugcagugccgcaucugcaucuga

SEQ ID NO: 62183 - RNA, 1701 nt, Artificial Sequence
  derived and/or modified sequence opt1 from hemagglutinin__InfluenzaA__ABI20848
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcucaaggagcagcugagcuccgucagcuccuucgagcgguucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgcgccaucuaccacaccgagaacgcgcacgugagcguggucuccagccacuacucccggcgcuucaccccggagaucgccaagcggcccaaggugcgcgaccaggagggccggaucaacuacuacuggacccuccuggagcccggcgacacgaucaucuucgaggccaacgggaaccugaucgcccccugguacgccuucgcgcucagccgcggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcggagcacgaagcugcgcauggugaccgggcuccggaacaucccguccauccagagccgcggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggucaacagcgugaucgagaagaugaacacccaguucaccgccguggggaaggaguucaacaagcuggagcggcgcauggagaaccucaacaagaaggucgacgacggcuuccuggacaucuggaccuacaacgcggagcugcucgugcugcuggagaacgagcggacgcucgacuuccacgacagcaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacagcgaggaguccaagcucaagcgcgagaagaucgacggcgucaagcuggagagcaugggcguguaccagauccuggccaucuacagcaccguggccuccagccucguccugcuggugucccucggggccaucagcuucuggaugugcuccaacggcagccugcagugccggaucugcaucuga

SEQ ID NO: 62184 - RNA, 1701 nt, Artificial Sequence; identical to SEQ ID NO: 61929
  derived and/or modified sequence opt1 from hemagglutinin__InfluenzaA__ABI20859

SEQ ID NO: 62185 - RNA, 1701 nt, Artificial Sequence
  derived and/or modified sequence opt1 from hemagglutinin__InfluenzaA__ABI20870
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccggagugcgagagccuguucuccaaggagagcugguccuacaucgccgagacccccaaccccgagaacgggaccugcuaccccggcaacuucgccgacuacgaggagcuccgggagcagcugagcuccgucagcuccuucgagcgcuucgagaucuucccgaaggagagcuccuggcccaaccacacggugaccaagggggugaccgucagcugcucccacaacggcaagagcuccuucuaccggaaccugcucuggcugaccgagaagaacgggcuguaccccaaccucagcaaguccuacgugaacaacaaggagaaggaggugcugguccuguggggcgugcaccaccccagcaacaugcgcgaccagcgggccaucuaccacacggagaacgccuacgugagcgucguguccagccacuacucccgccgguucaccccggagaucgcgaagcgccccaaggugcgggaccaggaggggcgcaucaacuacuacuggacccuccuggagcccggcgacaccaucaucuucgaggccaacggcaaccugaucgcgccccgguacgccuucgcccucagccgcggguucggcuccgggaucaucacgagcaacgccuccauggacgagugcgacgccaagugccagaccccgcagggcgccaucaacagcucccugcccuuccagaacguccaccccgugaccaucggcgagugccccaaguacgugcggagcaccaagcugcgcauggucacggggcuccggaacaucccguccauccagagccgcggccuguucggggccaucgccggcuucaucgagggcggcuggaccggcaugaucgacgggugguacggcuaccaccaccagaacgagcagggguccggcuacgcggccgaccagaaguccacccagaacgccaucaacgggaucaccaacaaggugaacagcgugaucgagaagaugaacacgcaguucaccgccgucggcaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacaacgagugcauggagagcgucaagaacgggacguacgacuaccccaaguacuccgaggagagcaagcucaaccgcgagaagaucgacggcgugaagcuggagagcauggggguguaccagauccuggccaucuacuccaccgucgccagcucccucgugcugcuggugagccucggcgccaucuccuucuggaugugcagcaacggcucccugcagugccggaucugcaucuga

SEQ ID NO: 62186 - RNA, 1701 nt, Artificial Sequence; identical to SEQ ID NO: 61997
  derived and/or modified sequence opt1 from hemagglutinin__InfluenzaA__ABI20881

SEQ ID NO: 62187 - RNA, 1701 nt, Artificial Sequence
  derived and/or modified sequence opt1 from hemagglutinin__InfluenzaA__ABI20892
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaaggagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcauccacuggaccaucgugaagcccggcgacauccuccugaucaccuccaccgggaaccugaucgcgccccggggcuacuucaagauccgcaacggcaagagcuccaucaugcggagcgacgccccgaucgggaacugcaacuccgagugcaucacgcccaacggcagcauccccaacgacaagcccuuccagaacgugaaccgcaucaccuacggggccugcccgcgguacgucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacuccgaggggaccggccaggccgccgaccucaagagcacccaggcggccaucgaccagaucaacggcaagcugaaccggcugaucgagaagaccaacgagaaguuccaccagaucgagaaggaguucuccgaggucgaggggcgcauccaggaccuggagaaguacguggaggacacgaagaucgaccucuggagcuacaacgccgagcugcugguggcccucgagaaccagcacaccaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggacguacgaccacgacgucuaccgcgacgaggcccugaacaaccgguuccagaucaagggcguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 62188 - RNA, 1701 nt, Artificial Sequence
  derived and/or modified sequence opt1 from hemagglutinin__InfluenzaA__ABI20903
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuacccguacgacgugcccgacuacgcgagccuccggucccuggucgccagcuccggcacgcuggaguucaccaacgagaacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccacccgagcacggacuccgaccagaccagccuguacgugcgcgccuccgggaaggucaccgugagcaccaagcggucccagcagacggugauccccgacaucggcuaccgccccuggguccgggggcucagcagccgcaucuccaucuacuggaccaucgugaagcccggcgacauccugcugauccacagcaccgggaaccucaucgccccgcggggcuacuucaagauccgcaacggcaaguccagcaucaugcgguccgacgcccccaucgggaacugcagcuccgagugcaucacccccaacggcagcauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggcuucaucgagaacgggugggagggcaugguggacgggugguacggcuuccgccaccagaacuccgaggggacgggccaggccgccgaccucaagagcacccaggcggccaucgaccagaucaacggcaagcugaaccggcuggucgagaagaccaacgagaaguuccaccagaucgagaaggaguucuccgagguggaggggcgcauccaggaccucgagaaguacguggaggacaccaagaucgaccuguggagcuacaacgccgagcugcucgucgcccuggagaaccagcacacgaucgaccugaccgacuccgagaugaacaagcuguucgagcggacccgcaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcgucgagcucaaguccggcuacaaggacuggauccuguggaucagcuucgccaucuccugcuuccugcucugcguggugcugcugggguucaucaugugggccugccagaagggcaacauccgcugcaacaucugcaucuga

SEQ ID NO: 62189 - RNA, 1701 nt, Artificial Sequence
  derived and/or modified sequence opt1 from hemagglutinin__InfluenzaA__ABI20914
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugagccugggcuucaucaugugggccugccagaaggggaacauccggugcaacaucugcaucuga

SEQ ID NO: 62190 - RNA, 1701 nt, Artificial Sequence; identical to SEQ ID NO: 62074
  derived and/or modified sequence opt1 from hemagglutinin__InfluenzaA__ABI20925

SEQ ID NO: 62191 - RNA, 1701 nt, Artificial Sequence; identical to SEQ ID NO: 62074
  derived and/or modified sequence opt1 from hemagglutinin__InfluenzaA__ABI20936

SEQ ID NO: 62192 - RNA, 1701 nt, Artificial Sequence
  derived and/or modified sequence opt1 from hemagglutinin__InfluenzaA__ABI20947
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagcaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 62193 - RNA, 1701 nt, Artificial Sequence
  derived and/or modified sequence opt1 from hemagglutinin__InfluenzaA__ABI20958
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcuguacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcuuccggcccuggguccgcgggcucuccagccggaucuccaucuacuggacgaucgugaagcccggcgacauccugcugaucaacagcaccgggaaccucaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccggccugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcgucgugcugcugggcuucaucaugugggccugccagaaggggaacauccggugcaacaucugcaucuga

SEQ ID NO: 62194 - RNA, 1701 nt, Artificial Sequence
  derived and/or modified sequence opt1 from hemagglutinin__InfluenzaA__ABI20969
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggaguggaaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugcuucaagaucuaccacaagugcgacaacgccugcaucggguccauccggaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcgucgugcuccugggguucaucaugugggccugccagaagggcaacauccgcugcaacaucugcaucuga

SEQ ID NO: 62195 - RNA, 1701 nt, Artificial Sequence
  derived and/or modified sequence opt1 from hemagglutinin__InfluenzaA__ABI20980
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggaccagaacgggaccuccagcgccugcaagcggcgcuccacgaaguccuucuucucccggcucaacuggcugcaccagcugaaguacaaguaccccgcccucaacgucaccaugcccaacaacgagaaguucgacaagcuguacaucuggggcgugcaccaccccagcaccgacuccgaccagaucagccuguacgcgcaggccagcgggcgcgugaccgucuccacgaagcggagccagcagaccgugaccccgaacaucggcucccgccccugggugcgcggggucagcucccggaucagcaucuacuggaccaucgugaagcccggcgacauccuccugaucaacuccacgggcaaccugaucgcgccccggggguacuucaagauccgcagcggcaaguccagcaucaugcgguccaacgcccucaucgggaagugcaacagcgagugcaucaccccgaacggcuccauccccaacgacaagcccuuccagaacgugaaccgcaucaccuacggcgccugcccccgguacgucaagcagaacacccugaagcuggccacggggaugcgcaacgugccggagaagcagacccggggcaucuucggggccaucgccggcuucaucgagaacgggugggagggcaugguggacggcugguacggguuccgccaccagaacagcgagggcaccgggcaggccgccgaccucaaguccacccaggcggccaucaaccagaucaacggcaagcugaaccggcugaucgagaagacgaacgagaaguuccaccagaucgagaaggaguucagcgaggucgaggggcgcauccaggaccucgagaaguacguggaggacaccaagaucgaccugugguccuacaacgccgagauccugguggcccucgagaaccagcacaccaucgaccugaccgacagcgagaugaacaagcuguucgagcggacgcgcaagcagcuccgcgagaacgccgaggacaugggcaacggcugcuucaagaucuaccacaagugcgacaacgcgugcaucggguccauccggaacggcaccuacgaccacgacgucuaccgcgacgaggcccugaacaaccgguuccagaucaaggggguggagcucaagagcggcuacaaggacuggauccuguggaucagcuucgccaucuccugcuuccugcugugcgucgugcuccugggguucaucaugugggccugccagaagggcaacauccgcugcaacaucugcaucuga

SEQ ID NO: 62196 - RNA, 1701 nt, Artificial Sequence
  derived and/or modified sequence opt1 from hemagglutinin__InfluenzaA__ABI20991
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccuccugaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaucaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 62197 - RNA, 1701 nt, Artificial Sequence; identical to SEQ ID NO: 61718
  derived and/or modified sequence opt1 from hemagglutinin__InfluenzaA__ABI21002

SEQ ID NO: 62198 - RNA, 1701 nt, Artificial Sequence; identical to SEQ ID NO: 62162
  derived and/or modified sequence opt1 from hemagglutinin__InfluenzaA__ABI21013

SEQ ID NO: 62199 - RNA, 1701 nt, Artificial Sequence; identical to SEQ ID NO: 61648
  derived and/or modified sequence opt1 from hemagglutinin__InfluenzaA__ABI21024

SEQ ID NO: 62200 - RNA, 1701 nt, Artificial Sequence; identical to SEQ ID NO: 61524
  derived and/or modified sequence opt1 from hemagglutinin__InfluenzaA__ABI21035

SEQ ID NO: 62201 - RNA, 1701 nt, Artificial Sequence
  derived and/or modified sequence opt1 from hemagglutinin__InfluenzaA__ABI21046
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 62202 - RNA, 1701 nt, Artificial Sequence
  derived and/or modified sequence opt1 from hemagglutinin__InfluenzaA__ABI21057
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggaccacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 62203 - RNA, 1701 nt, Artificial Sequence; identical to SEQ ID NO: 61251
  derived and/or modified sequence opt1 from hemagglutinin__InfluenzaA__ABI21068

SEQ ID NO: 62204 - RNA, 1701 nt, Artificial Sequence; identical to SEQ ID NO: 61290
  derived and/or modified sequence opt1 from hemagglutinin__InfluenzaA__ABI21079

SEQ ID NO: 62205 - RNA, 1701 nt, Artificial Sequence; identical to SEQ ID NO: 62121
  derived and/or modified sequence opt1 from hemagglutinin__InfluenzaA__ABI21090

SEQ ID NO: 62206 - RNA, 1701 nt, Artificial Sequence; identical to SEQ ID NO: 62121
  derived and/or modified sequence opt1 from hemagglutinin__InfluenzaA__ABI21101

SEQ ID NO: 62207 - RNA, 1701 nt, Artificial Sequence
  derived and/or modified sequence opt1 from hemagglutinin__InfluenzaA__ABI21123
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccaacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaagcacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 62208 - RNA, 1701 nt, Artificial Sequence
  derived and/or modified sequence opt1 from hemagglutinin__InfluenzaA__ABI21134
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagagcuccagcaccgggggcaucugcgacagcccccaccagauccucgacggggagaacugcacccugauggacgcccugcucggcgacccccagugcgacggcuuccagaacaagaagugggaccuguucguggagcgcagcaaggccuacuccaacugcuaccccuacgacgucccggacuacgcgagccugcggucccucguggccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucagccuguacgcgcaggccuccggccggaucaccgugagcacgaagcgcagccagcagaccgucaucccgaacaucggcucccggagccgcgugcgggacauccccucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 62209 - RNA, 1701 nt, Artificial Sequence; identical to SEQ ID NO: 61290
  derived and/or modified sequence opt1 from hemagglutinin__InfluenzaA__ABI21156

SEQ ID NO: 62210 - RNA, 1701 nt, Artificial Sequence
  derived and/or modified sequence opt1 from hemagglutinin__InfluenzaA__ABI21167
augaagaccaucaucgcccugggcuacauccucugccugguguucgcccagaagcugcccgggaacgacaacagcaccgcgacgcucugccugggccaccacgccgucccgaacgggaccaucgugaagaccaucaccaacgaccagaucgaggugacgaacgccaccgagcugguccaguccagcuccaccggcgggaucugcgacagcccccaccagauccucgacggcgagaacugcacccugaucgacgcccugcucggcgacccccagugcgacggguuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccaacaacgaccagaucucccuguacgcgcaggccagcggccggaucaccguguccacgaagcgcagccagcagaccgugaucccgaacaucgggagccggccccgcguccgggacauccccucccgcaucagcaucuacuggaccaucgugaagcccggcgacauccugcucaucaacuccaccgggaaccugaucgccccgcggggcuacuucaagauccgcagcggcaaguccagcaucaugcgguccgacgcccccaucgggaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggcuucaucgagaacgggugggagggcaugguggacgggugguacggcuuccgccaccagaacagcgaggggaucggccaggccgccgaccugaaguccacccaggcggccaucaaccagaucaacggcaagcugaaccggcucaucgggaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgaggucuaccgggacgaggcccucaacaaccgcuuccagaucaagggcguggagcucaagagcggguacaaggacuggauccuguggaucuccuucgccaucagcugcuuccugcugugcguggcccugcucggcuucaucaugugggccugccagaaggggaacauccggugcaacaucugcaucuga

SEQ ID NO: 62211 - RNA, 1701 nt, Artificial Sequence
  derived and/or modified sequence opt1 from hemagglutinin__InfluenzaA__ABI21178
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccagcugcuaccccuacgacgugccggacuacgcgucccugcggagccucgucgccuccagcgggacgcuggaguucaacaacgaguccuucaacuggaccggcgugacccagaacgggaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccaacaacgaccagaucucccuguacgcgcaggccagcggccggaucaccgugagcacgaagcgcucccagcagaccgugaucccgaacaucggcagccggccccgcguccgggacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62212 - RNA, 1698 nt, Artificial Sequence
  derived and/or modified sequence opt1 from hemagglutinin__InfluenzaA__ABI21200
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagcggaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 62213 - RNA, 1698 nt, Artificial Sequence; identical to SEQ ID NO: 62212
  derived and/or modified sequence opt1 from hemagglutinin__InfluenzaA__ABI21211

SEQ ID NO: 62214 - RNA, 1698 nt, Artificial Sequence
  derived and/or modified sequence opt1 from hemagglutinin__InfluenzaA__ABI21233
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucaacuccgugagcuccuucgagcgguucgagaucuucccgaaggagagcuccuggcccaaccacaccgucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgcgagcggaucgacggcgugaagcuggagagcaugggcgucuaccagauccuggccaucuacuccacgguggccagcagccucgugcugcuggucucccucggggccaucagcuucuggaugugcuccaacggcagccugcagugccgcaucugcaucuga

SEQ ID NO: 62215 - RNA, 1701 nt, Artificial Sequence
  derived and/or modified sequence opt1 from hemagglutinin__InfluenzaA__ABI21244
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcugaaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcucccggcccuggguccgcgggcucagcucccggaucagcaucuacuggacgaucgugaagcccggcgacauccugcugaucaacuccaccgggaaccucaucgcgccccgcggcuacuucaagauccggagcggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccucgagaaguacguggaggacaccaagaucgaccuguggagcuacaacgccgagcugcucguggcccuggagaaccagcacaccaucgaccugacggacuccgagaugaacaagcuguucgagcgcacccgcaagcagcuccgggagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaaguccggcuacaaggacuggauccuguggaucagcuucgccaucagcugcuuccugcucugcgucgugcugcugggguucaucaugugggccugccagaagggcaacauccggugcaacaucugcaucuga

SEQ ID NO: 62216 - RNA, 1701 nt, Artificial Sequence; identical to SEQ ID NO: 62061
  derived and/or modified sequence opt1 from hemagglutinin__InfluenzaA__ABI21255

SEQ ID NO: 62217 - RNA, 1701 nt, Artificial Sequence; identical to SEQ ID NO: 62061
  derived and/or modified sequence opt1 from hemagglutinin__InfluenzaA__ABI21266

SEQ ID NO: 62218 - RNA, 1701 nt, Artificial Sequence; identical to SEQ ID NO: 62061
  derived and/or modified sequence opt1 from hemagglutinin__InfluenzaA__ABI21277

SEQ ID NO: 62219 - RNA, 1701 nt, Artificial Sequence
  derived and/or modified sequence opt1 from hemagglutinin__InfluenzaA__ABI21299
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacgacaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcucccggcccuggguccgcggccucagcucccggaucagcaucuacuggacgaucgugaagcccggggacauccugcugaucaacuccaccggcaaccucaucgcgccccgcggguacuucaagauccggaacggcaagagcuccaucaugcgcagcgacgccccgaucggcaacugcuccagcgagugcaucacccccaacggguccauccccaacgacaagcccuuccagaacgugaaccggaucaccuacggcgccugcccgcgcuacgucaagcagaacacgcugaagcuggccaccgggaugcggaacgugcccgagaagcagacccgcggcaucuucggggccaucgccggcuucaucgagaacggcugggaggggaugguggacggcugguacggguuccggcaccagaacagcgagggcaccgggcaggccgccgaccucaaguccacgcaggcggccaucgaccagaucaacggcaagcugaaccgccugaucgagaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacaccaucgaccugacggacagcgagaugaacaagcuguucgagcgcacccgcaagcagcuccgggagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcucugcgucgugcugcugggcuucaucaugugggccugccagaaggggaacauccggugcaacaucugcaucuga

SEQ ID NO: 62220 - RNA, 1701 nt, Artificial Sequence; identical to SEQ ID NO: 62061
  derived and/or modified sequence opt1 from hemagglutinin__InfluenzaA__ABI21310

SEQ ID NO: 62221 - RNA, 1701 nt, Artificial Sequence
  derived and/or modified sequence opt1 from hemagglutinin__InfluenzaA__ABI21321
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcucccggcccuggguccgcgggcucagcucccggaucagcaucuacuggacgaucgugaagcccggcgacauccugcugaucaacuccaccgggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacagcgagaugaacaagcuguucgagaagacccgcaagcagcuccgcgagaacgccgaggacaugggcaacgggugcuucaagaucuaccacaagugcgacaacgcgugcaucggcuccauccggaacgggaccuacgaccacgacgucuaccgcgacgaggcccugaacaaccgguuccagaucaagggcguggagcucaagagcggcuacaaggacuggauccuguggaucuccuucgccaucagcugcuuccugcucugcgucgugcugcugggguucaucaugugggccugccagaagggcaacauccgcugcaacaucugcaucuga

SEQ ID NO: 62222 - RNA, 1701 nt, Artificial Sequence
  derived and/or modified sequence opt1 from hemagglutinin__InfluenzaA__ABI21332
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcaggccuccgggcgcgucaccgugagcaccaagcggagccagcagaccgugaucccgaacaucggcucccgccccuggguccgggggcucagcucccgcaucagcaucuacuggacgaucgugaagcccggcgacauccugcugaucaacuccaccgggaaccucaucgcgccccggggcuacuucaagauccgcaacggcaagagcuccaucaugcggagcgacgccccgaucgggaacugcuccagcgagugcaucacccccaacggcuccauccccaacgacaagcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugguggacgggugguacggcuuccgccaccagaacagcgaggggaccggccaggccgccgaccucaaguccacgcaggcggccaucgaccagaucaacggcaagcugaaccggcugaucgagaagaccaacgagaaguuccaccagaucgagaaggaguucagcgaggucgaggggcgcauccaggaccucgagaaguacguggaggacaccaagaucgaccugugguccuacaacgccgagcugcucguggcccuggagaaccagcacaccaucgaccugacggacagcgagaugaacaagcuguucgagcggacccgcaagcagcuccgcgagaacgccgaggacaugggcaacgggugcuucaagaucuaccacaagugcgacaacgcgugcaucggcuccauccggaacgggaccuacgaccacgacgucuaccgcgacgaggcccugaacaaccgguuccagaucaagggcguggagcucaagagcggcuacaaggacuggauccuguggaucuccuucgccaucagcugcuuccugcucugcgucgugcugcugggguucaucaugugggccugccagaagggcaacauccgcugcaacaucugcaucuga

SEQ ID NO: 62223 - RNA, 1701 nt, Artificial Sequence; identical to SEQ ID NO: 62061
  derived and/or modified sequence opt1 from hemagglutinin__InfluenzaA__ABI21343

SEQ ID NO: 62224 - RNA, 1701 nt, Artificial Sequence
  derived and/or modified sequence opt1 from hemagglutinin__InfluenzaA__ABI21354
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcaagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaucaacgaggacuucaacuggaccgggguggcccaggacggcaaguccuacgccugcaagcgcgggagcgugaacuccuucuucagccggcugaacuggcuccacaagcuggaguacaaguaccccgcgcugaacgucaccaugcccaacaacggcaaguucgacaagcucuacaucuggggcgugcaccaccccuccaccgacagcgaccagacgucccuguacgugcgcgccagcgggcgggucaccgugagcaccaagcgcucccagcagaccgugaucccgaacaucggcagccggcccuggguccgcgggcuguccagccggaucuccaucuacuggacgaucgugaagcccggcgacauccuccugaucaacagcaccgggaaccugaucgcgccccgcggcuacuucaagauccggaacggcaaguccagcaucaugcgcuccgacgccccgaucgggaacugcagcuccgagugcaucacccccaacggcagcauccccaacgacaagcccuuccagaacgugaaccggaucaccuacggggccugcccgcgcuacgucaagcagaacacgcucaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaccggccaggccgccgaccucaagagcacgcaggcggccaucgaccagaucaacggcaagcugaaccgccugaucgagaagaccaacgagaaguuccaccagaucgagaaggaguucuccgaggucgaggggcggauccaggaccuggagaaguacguggaggacaccaagaucgaccucuggagcuacaacgccgagcugcugguggcccucgagaaccagcacaccaucgaccugacggacuccgagaugaacaagcuguucgagcgcacccgcaagcagcuccgggagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcugaaguccggcuacaaggacuggauccucuggaucagcuucgccaucagcugcuuccugcugugcgucgugcuccugggguucaucaugugggccugccagaagggcaacauccggugcaacaucugcaucuga

SEQ ID NO: 62225 - RNA, 1701 nt, Artificial Sequence
  derived and/or modified sequence opt1 from hemagglutinin__InfluenzaA__ABI21365
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcucccggcccuggguccgcgggcucagcucccggaucagcaucuacuggacgaucgugaagcccggcgacauccugcugaucaacuccaccgggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggcggccaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacagcgagauggacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacgucuaccgggacgaggcccugaacaaccgcuuccagaucaagggcguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 62226 - RNA, 1701 nt, Artificial Sequence
  derived and/or modified sequence opt1 from hemagglutinin__InfluenzaA__ABI21376
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacuccugcaagcgcgggagcgugaacuccuucuucagccggcucaacuggcugcacaagcuggaguacaaguaccccgcccucaacgucaccaugcccaacaacgacaaguucgacaagcuguacaucuggggcgugcaccaccccuccaccgacagcgaccagacgucccuguacgugcgcgcgagcgggcgggucaccgugagcaccaagcgcucccagcagaccgugaucccgaacaucggcagccggcccuggguccgcggccucuccagccggaucuccaucuacuggacgaucgugaagcccggggacauccugcugaucaacagcaccggcaaccucaucgcgccccgcggguacuucaagauccggaacggcaaguccagcaucaugcgcuccgacgccccgaucggcaacugcagcuccgagugcaucacccccaacgggagcauccccaacgacaagcccuuccagaacgugaaccggaucaccuacggcgccugcccgcgcuacgucaagcagaacacgcugaagcuggccaccgggaugcggaacgugcccgagaagcagacccgcggcaucuucggggccaucgccggcuucaucgagaacggcugggaggggaugguggacggcugguacggguuccggcaccagaacuccgagggcaccgggcaggccgccgaccucaagagcacgcaggccgcgaucgaccagaucaacggcaagcugaaccgccugaucgagaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagcgcacccgcaagcagcuccgggagaacgccgaggacauggggaacggcugcuucaagaucuaccacaagugcgacaacgccugcaucgggagcauccgcaacggcaccuacgaccacgacgucuaccgggacgaggcgcugaacaaccgcuuccagaucaaggggguggagcucaaguccggcuacaaggacuggauccuguggaucagcuucgccaucagcugcuuccugcucugcgucgugcugcugggcuucaucaugugggccugccagaaggggaacauccggugcaacaucugcaucuga

SEQ ID NO: 62227 - RNA, 1701 nt, Artificial Sequence; identical to SEQ ID NO: 62061
  derived and/or modified sequence opt1 from hemagglutinin__InfluenzaA__ABI21387

SEQ ID NO: 62228 - RNA, 1701 nt, Artificial Sequence
  derived and/or modified sequence opt1 from hemagglutinin__InfluenzaA__ABI21398
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucgugaacgaggacuucaacuggaccgggguggcccaggacggcaagagcuacgccugcaagcgcggguccgucaacagcuucuucucccggcucaacuggcugcacaagcuggaguacaaguaccccgcgcucaacgugaccaugcccaacaacggcaaguucgacaagcuguacaucuggggcgugcaccaccccagcaccgacuccgaccagacgagccuguacguccgcgccuccgggcgggugaccgugagcaccaagcgcagccagcagaccgucaucccgaacaucggcucccggcccugggugcgcgggcucagcucccggaucagcaucuacuggacgaucgugaagcccggcgacauccugcugaucaacuccaccgggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgucaaccggaucaccuacggggccugcccgcgcuacgugaagcagaacacgcugaagcuggccaccggcaugcggaacgugcccgagaagcagacccgcgggaucuucggcgccaucgccggcuucaucgagaacgggugggagggcauggucgacgggugguacggcuuccggcaccagaacagcgaggggaccggccaggccgccgaccucaaguccacgcaggcggccaucgaccagaucaacggcaagcugaaccgccugaucgagaagaccaacgagaaguuccaccagaucgagaaggaguucagcgagguggaggggcggauccaggaccucgagaaguacguggaggacaccaagaucgaccugugguccuacaacgccgagcugcucgucgcccuggagaaccagcacaccaucgaccugacggacagcgagaugaacaagcuguucgagcgcacccgcaagcagcuccgggagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcucaagagcggcuacaaggacuggauccuguggaucuccuucgccaucagcugcuuccugcucugcguggugcugcugggguucaucaugugggccugccagaagggcaacauccggugcaacaucugcaucuga

SEQ ID NO: 62229 - RNA, 1701 nt, Artificial Sequence; identical to SEQ ID NO: 62061
  derived and/or modified sequence opt1 from hemagglutinin__InfluenzaA__ABI21409

SEQ ID NO: 62230 - RNA, 1701 nt, Artificial Sequence
  derived and/or modified sequence opt1 from hemagglutinin__InfluenzaA__ABI21420
augaagaccaucaucgcccugagcuacauccucugccugguguucacccagaagcugcccggcaacgacaacuccacggccacccucugccuggggcaccacgcggucccgaacggcacccuggugaagaccaucacgaacgaccagaucgaggugaccaacgccaccgagcucguccagagcuccagcaccgggcgcaucugcgacagcccccaccggauccuggacggcaagaacugcacgcugaucgacgcccuccugggggacccccacugcgacggcuuccagaacaaggagugggaccuguucguggagcgcuccaaggccuacuccaacugcuaccccuacgacgugccggacuacgccagccuccggucccuggucgcgagcuccggcacccuggaguucaucaacgaggacuucaacuggaccgggguggcccaggacggcgggagcuacuccugcaagcgcggcagcgugaacuccuucuucagccggcucaacuggcugcacaagcuggaguacaaguaccccgcccucaacgucaccaugcccaacaacgggaaguucgacaagcuguacaucuggggcgugcaccaccccuccacggacagcgaccagaccucccuguacgugcgcgccagcggccgggucaccgugagcaccaagcgcucccagcagacggugaucccgaacaucgggagccggcccuggguccgcggccucuccagccggaucuccaucuacuggaccaucgugaagcccggggacauccugcugaucaacagcaccggcaaccucaucgcgccccgcggcuacuucaagauccggaacgggaaguccagcaucaugcgcuccgacgccccgaucggcaacugcagcuccgagugcaucacccccaacgggagcauccccaacgacaagcccuuccagaacgugaaccggaucacguacggcgccugcccgcgcuacgucaagcagaacacccugaagcuggccaccgggaugcggaacgugcccgagaagcagacccgcggcaucuucggcgccaucgcgggguucaucgagaacggcugggaggggaugguggacggcugguacggguuccggcaccagaacuccgagggcacgggccaggccgccgaccucaagagcacccaggccgccaucgaccagaucaacgggaagcugaaccgccugaucgagaagaccaacgagaaguuccaccagaucgagaaggaguucuccgaggucgagggccggauccaggaccucgagaaguacguggaggacaccaagaucgaccuguggagcuacaacgcggagcugcucguggcccuggagaaccagcacacgaucgaccugaccgacuccgagaugaacaagcuguucgagcgcacccgcaagcagcuccgggagaacgccgaggacauggggaacggcugcuucaagaucuaccacaagugcgacaacgccugcaucgggagcauccgcaacggcaccuacgaccacgacgucuaccgggacgaggcccugaacaaccgcuuccagaucaaguccguggagcucaagagcggcuacaaggacuggauccuguggaucagcuucgcgaucuccugcuuccugcucugcgucgugcugcugggguucaucaugugggccugccagaagggcaacauccggugcaacaucugcaucuga

SEQ ID NO: 62231 - RNA, 1701 nt, Artificial Sequence; identical to SEQ ID NO: 62061
  derived and/or modified sequence opt1 from hemagglutinin__InfluenzaA__ABI21431

SEQ ID NO: 62232 - RNA, 1701 nt, Artificial Sequence; identical to SEQ ID NO: 62061
  derived and/or modified sequence opt1 from hemagglutinin__InfluenzaA__ABI21442

SEQ ID NO: 62233 - RNA, 1701 nt, Artificial Sequence; identical to SEQ ID NO: 62061
  derived and/or modified sequence opt1 from hemagglutinin__InfluenzaA__ABI21453

SEQ ID NO: 62234 - RNA, 1701 nt, Artificial Sequence; identical to SEQ ID NO: 62061
  derived and/or modified sequence opt1 from hemagglutinin__InfluenzaA__ABI21464

SEQ ID NO: 62235 - RNA, 1701 nt, Artificial Sequence; identical to SEQ ID NO: 62061
  derived and/or modified sequence opt1 from hemagglutinin__InfluenzaA__ABI21475

SEQ ID NO: 62236 - RNA, 1701 nt, Artificial Sequence
  derived and/or modified sequence opt1 from hemagglutinin__InfluenzaA__ABI21486
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugaucccgaacaucggcucccggcccuggguccgcgggcucagcucccggaucagcaucuacuggacgaucgugaagcccggcgacauccugcugaucaacuccaccgggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggaggcgaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacaccaucgaccugacggacagcgagaugaacaagcuguucgagcgcacccgcaagcagcuccgggagaacgccgaggacaugggcaacgggugcuucaagaucuaccacaagugcgacaacgccugcaucggcuccauccgcaacgggaccuacgaccacgacgucuaccgggacgaggcgcugaacaaccgcuuccagaucaagggcguggagcucaagagcggcuacaaggacuggauccuguggaucuccuucgccaucagcugcuuccugcucugcgucgugcugcugggguucaucaugugggccugccagaagggcaacauccggugcaacaucugcaucuga

SEQ ID NO: 62237 - RNA, 1701 nt, Artificial Sequence; identical to SEQ ID NO: 62061
  derived and/or modified sequence opt1 from hemagglutinin__InfluenzaA__ABI21497

SEQ ID NO: 62238 - RNA, 1698 nt, Artificial Sequence
  derived and/or modified sequence opt1 from hemagglutinin__InfluenzaA__ABI21530
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgugaccggggucagcgccuccugcagccacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacaucggggugcagcgggccaucuaccgcacggagaacgccuacgucuccguggugagcucccacuacagccggcgcuucaccccggagaucgccaagcggcccaagguccgcgaccaggagggccggaucaacuacuacuggacccugcuggagcccggcgacaccaucaucuucgaggcgaacgggaaccucaucgcccccugguacgccuucgcccugucccgcggcuucgagagcgggaucaucacguccaacgccccgaugaacgagugcgacgcgaagugccagacgccccagggcgccaucaacagcucccugcccuuccagaacgugcaccccgugaccaucggcgagugcccgaaguacguccggagcgccaagcuccgcauggugaccgggcugcggaacauccccuccauccagagccgcggccuguucggggccaucgccggcuucaucgagggcggguggaccggcaugaucgacgggugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcucgagcggcgcauggagaaccugaacaagaaggucgacgacggcuuccuggacaucuggaccuacaacgccgagcuccuggugcugcucgagaacgagcggacccuggacuuccacgacagcaacgugaagaaccuguacgagaaggucaagucccagcucaagaacaacgcgaaggagaucgggaacggcugcuucgaguucuaccacaagugcaacaacgagugcauggagagcgugaagaacgggaccuacgacuaccccaaguacuccgaggagagcaagcugaaccgcgagaagaucgacggcgugaagcuggagagcaugggggucuaccagauccucgccaucuacuccacgguggccagcucccuggugcugcucgucagccugggcgccaucuccuucuggaugugcagcaacggcucccugcagugccggaucugcaucuga

SEQ ID NO: 62239 - RNA, 1698 nt, Artificial Sequence
  derived and/or modified sequence opt1 from hemagglutinin__InfluenzaA__ABI21552
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgugaccggggucagcgccuccugcagccacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacaucggggugcagcgggccaucuaccacacggagaacgccuacgucuccguggugagcucccacuacagccgccgguucaccccggagaucgccaagcgccccaagguccgggaccaggagggccgcaucaacuacuacuggacccugcuggagcccggcgacaccaucaucuucgaggcgaacgggaaccucaucgcccccugguacgccuucgcccugucccggggcuucgagagcgggaucaucacguccaacgccccgauggacgagugcgacgcgaagugccagacgccccagggcgccaucaacagcucccugcccuuccagaacgugcaccccgugaccaucggcgagugcccgaaguacguccgcagcgccaagcuccggauggugaccgggcugcgcaacauccccuccauccagagccggggccuguucggggccaucgccggcuucaucgagggcggguggaccggcaugaucgacgggugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcucgagcgccggauggagaaccugaacaagaaggucgacgacggcuuccuggacaucuggaccuacaacgccgagcuccuggugcugcucgagaacgagcgcacccuggacuuccacgacagcaacgugaagaaccuguacgagaaggucaagucccagcucaagaacaacgcgaaggagaucgggaacggcugcuucgaguucuaccacaagugcaacaacgagugcauggagagcgugaagaacgggaccuacgacuaccccaaguacuccgaggagagcaagcugaaccgggagaagaucgacggcgugaagcuggagagcaugggggucuaccagauccucgccaucuacuccacgguggccagcucccuggugcugcucgucagccugggcgccaucuccuucuggaugugcagcaacggcucccugcagugccgcaucugcaucuga

SEQ ID NO: 62240 - RNA, 1698 nt, Artificial Sequence
  derived and/or modified sequence opt1 from hemagglutinin__InfluenzaA__ABI21563
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgugaccggggucagcgccuccugcagccacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacaucggggugcagcgggccaucuaccacacggagaacgccuacgucuccguggugagcucccacuacagccgccgguucaccccggagaucgccaagcgccccaagguccggggccaggagggccgcaucaacuacuacuggacccugcuggagcccggggacaccaucaucuucgaggcgaacggcaaccucaucgcccccugguacgccuucgcccugucccggggguucgagagcggcaucaucacguccaacgccccgaugaacgagugcgacgcgaagugccagacgccccagggcgccaucaacagcucccugcccuuccagaacgugcaccccgugaccaucggggagugcccgaaguacguccgcagcgccaagcuccggauggugaccggccugcgcaacauccccuccauccagagccgggggcuguucggcgccaucgccggguucaucgagggcggcuggaccgggaugaucgacggcugguacggguaccaccaccagaacgagcagggcuccggguacgcggccgaccagaaguccacccagaacgccaucaacggcaucaccaacaaggugaacagcgucaucgagaagaugaacacccaguucacggccgugggcaaggaguucaacaagcucgagcgccggauggagaaccugaacaagaaggucgacgacggguuccuggacaucuggaccuacaacgccgagcuccuggugcugcucgagaacgagcgcacccuggacuuccacgacagcaacgugaagaaccuguacgagaaggucaagucccagcucaagaacaacgcgaaggagaucggcaacgggugcuucgaguucuaccacaagugcaacaacgagugcauggagagcgugaagaacggcaccuacgacuaccccaaguacuccgaggagagcaagcugaaccgggagaagaucgacggggugaagcuggagagcaugggcgucuaccagauccucgccaucuacuccacgguggccagcucccuggugcugcucgucagccugggcgccaucuccuucuggaugugcagcaacgggucccugcagugccgcaucugcaucuga

SEQ ID NO: 62241 - RNA, 1698 nt, Artificial Sequence; identical to SEQ ID NO: 62240
  derived and/or modified sequence opt1 from hemagglutinin__InfluenzaA__ABI21574

SEQ ID NO: 62242 - RNA, 1701 nt, Artificial Sequence
  derived and/or modified sequence opt1 from hemagglutinin__InfluenzaA__ABI21736
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccuccugaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgcggaggacguggggaacggcugcuucaagaucuaccacaagugcgacaacgccugcaucgggagcauccgcaacggcaccuacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggcuucaucaugugggccugccagaaggggaacauccgcugcaacaucugcaucuga

SEQ ID NO: 62243 - RNA, 1701 nt, Artificial Sequence
  derived and/or modified sequence opt1 from hemagglutinin__InfluenzaA__ABI22159
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaacgccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 62244 - RNA, 1707 nt, Artificial Sequence
  derived and/or modified sequence opt1 from hemagglutinin__InfluenzaA__ABI23979
auggagaagaucgugcugcuccuggccaucaucagccuggucaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccguggccggguggcugcucggcaacccgaugugcgacgaguuccugaacguccccgaguggagcuacaucguggagaagaucaaccccgccaacgaccugugcuaccccgggaacuucaacgacuacgaggagcucaagcaccuccugucccggaucaaccacuucgagaagauccagaucauccccaagagcuccuggagcgaccacgaggccuccagcggcguguccagcgccugcccguaccagggccgcuccagcuucuuccggaacgucguguggcugaucaagaaggacaacgcguaccccaccaucaagcgcuccuacaacaacacgaaccaggaggaccugcuggugcucugggggauccaccaccccaacgacgccgccgagcagacccggcuguaccagaacccgaccaccuacaucagcgucggcacguccacccugaaccagcgccucgugcccaagaucgccacccggagcaaggugaacgggcaguccggccgcauggaguucuucuggaccauccugaagcccaacgacgcgaucaacuucgagagcaacgggaacuucaucgcccccgagaacgccuacaagaucgucaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgucaagagcaaccggcuggugcuggccacggggcuccgcaacuccccgcagggcgagcggcgccggaagaagcgcggccuguucggggcgaucgccggcuucaucgagggcggguggcaggggaugguggacggcugguacggcuaccaccacagcaacgagcagggguccggcuacgccgccgacaaggagagcacccagaaggccaucgacggggugaccaacaaggugaacuccaucaucgacaagaugaacacccaguucgaggcggucggccgggaguucaacaaccuggagcgccggaucgagaaccucaacaagaagauggaggacggguuccuggacguguggacguacaacgccgagcugcucgugcugauggagaacgagcgcacccuggacuuccacgacagcaacgucaagaaccucuacgacaaggugcggcugcagcugcgcgacaacgccaaggagcucggcaacggcugcuucgaguucuaccaccggugcgacaacgagugcauggaguccguccgcaacgggaccuacgacuacccccaguacagcgaggagucccgccugaagcgggaggagaucagcggcgugaagcuggaguccaucgggaccuaccagauccucagcaucuacuccacgguggccagcucccuggcccuggcgaucauggucgccggccucagccuguggaugugcagcaacgggucccugcagugccgcaucugcaucuga

SEQ ID NO: 62245 - RNA, 1701 nt, Artificial Sequence; identical to SEQ ID NO: 61290
  derived and/or modified sequence opt1 from hemagglutinin__InfluenzaA__ABI26646

SEQ ID NO: 62246 - RNA, 1701 nt, Artificial Sequence; identical to SEQ ID NO: 61919
  derived and/or modified sequence opt1 from hemagglutinin__InfluenzaA__ABI30367

SEQ ID NO: 62247 - RNA, 1701 nt, Artificial Sequence; identical to SEQ ID NO: 61929
  derived and/or modified sequence opt1 from hemagglutinin__InfluenzaA__ABI30378

SEQ ID NO: 62248 - RNA, 1701 nt, Artificial Sequence; identical to SEQ ID NO: 61658
  derived and/or modified sequence opt1 from hemagglutinin__InfluenzaA__ABI30400

SEQ ID NO: 62249 - RNA, 1701 nt, Artificial Sequence
  derived and/or modified sequence opt1 from hemagglutinin__InfluenzaA__ABI30411
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccuccugaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagauggacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 62250 - RNA, 1701 nt, Artificial Sequence; identical to SEQ ID NO: 61599
  derived and/or modified sequence opt1 from hemagglutinin__InfluenzaA__ABI30422

SEQ ID NO: 62251 - RNA, 1701 nt, Artificial Sequence; identical to SEQ ID NO: 61290
  derived and/or modified sequence opt1 from hemagglutinin__InfluenzaA__ABI30433

SEQ ID NO: 62252 - RNA, 1701 nt, Artificial Sequence; identical to SEQ ID NO: 61599
  derived and/or modified sequence opt1 from hemagglutinin__InfluenzaA__ABI30444

SEQ ID NO: 62253 - RNA, 1701 nt, Artificial Sequence; identical to SEQ ID NO: 61290
  derived and/or modified sequence opt1 from hemagglutinin__InfluenzaA__ABI30455

SEQ ID NO: 62254 - RNA, 1701 nt, Artificial Sequence; identical to SEQ ID NO: 61290
  derived and/or modified sequence opt1 from hemagglutinin__InfluenzaA__ABI30466

SEQ ID NO: 62255 - RNA, 1701 nt, Artificial Sequence; identical to SEQ ID NO: 61290
  derived and/or modified sequence opt1 from hemagglutinin__InfluenzaA__ABI30477

SEQ ID NO: 62256 - RNA, 1701 nt, Artificial Sequence; identical to SEQ ID NO: 61290
  derived and/or modified sequence opt1 from hemagglutinin__InfluenzaA__ABI30488

SEQ ID NO: 62257 - RNA, 1701 nt, Artificial Sequence; identical to SEQ ID NO: 61290
  derived and/or modified sequence opt1 from hemagglutinin__InfluenzaA__ABI30499

SEQ ID NO: 62258 - RNA, 1701 nt, Artificial Sequence; identical to SEQ ID NO: 61251
  derived and/or modified sequence opt1 from hemagglutinin__InfluenzaA__ABI30510

SEQ ID NO: 62259 - RNA, 1701 nt, Artificial Sequence
  derived and/or modified sequence opt1 from hemagglutinin__InfluenzaA__ABI30521
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccaacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgccuccaucggcaagugcaacagcgagugcaucacgcccaacggguccauccccaacgacaagcccuuccagaacgugaaccgcaucaccuacggcgccugcccgcgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62260 - RNA, 1701 nt, Artificial Sequence; identical to SEQ ID NO: 61290
  derived and/or modified sequence opt1 from hemagglutinin__InfluenzaA__ABI30532

SEQ ID NO: 62261 - RNA, 1701 nt, Artificial Sequence; identical to SEQ ID NO: 62121
  derived and/or modified sequence opt1 from hemagglutinin__InfluenzaA__ABI30543

SEQ ID NO: 62262 - RNA, 1701 nt, Artificial Sequence; identical to SEQ ID NO: 61290
  derived and/or modified sequence opt1 from hemagglutinin__InfluenzaA__ABI30554

SEQ ID NO: 62263 - RNA, 1698 nt, Artificial Sequence; identical to SEQ ID NO: 62212
  derived and/or modified sequence opt1 from hemagglutinin__InfluenzaA__ABI30565

SEQ ID NO: 62264 - RNA, 1701 nt, Artificial Sequence; identical to SEQ ID NO: 61641
  derived and/or modified sequence opt1 from hemagglutinin__InfluenzaA__ABI30587

SEQ ID NO: 62265 - RNA, 1701 nt, Artificial Sequence
  derived and/or modified sequence opt1 from hemagglutinin__InfluenzaA__ABI30609
augaagaccaucaucgcccugagcuacauccucugccugguguucgcccagaagcugcccggcaacgacaacuccaccgcgacgcucugccuggggcaccacgccgucccgaacggcaccaucgugaagaccaucaugaacgaccagaucgaggugaccaacgccacggagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacccuggaguucaacaacgagagcuucaacuggacgggcgugacccagaacgggaccuccagcgccugcaagcgccgguccaacaacagcuucuucucccgccugaacuggcucacccaccugaaguucaaguaccccgcccugaacgugacgaugcccaacaacgagaaguucgacaagcucuacaucuggggcguccaccaccccgggaccgacaacgaccagaucuuccuguacgcgcaggccagcggccggaucaccguguccaccaagcgcagccagcagacggugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacccccaacggguccauccccaacgacaagccguuccagaacgugaaccgcaucacguacggcgccugcccccgguacgucaagcagaacacccugaagcucgcgaccgggaugcgcaacgugcccgagaagcagacccggggcaucuucggggccaucgccggcuucaucgagaacggcugggaggggaugguggacggcugguacggguuccgccaccagaacagcgagggcacggggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62266 - RNA, 1701 nt, Artificial Sequence
  derived and/or modified sequence opt1 from hemagglutinin__InfluenzaA__ABI30620
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucaucgagcgcagcaaggccuacuccaacugcuaccccuacgacgugccggacuacgcgagccugcggucccucguggccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucagccuguacgcgcaggccuccggccggaucaccgucagcacgaagcgcagccagcagaccgugaucccgaacaucggcucccggccccgcgugcgggacauccccagccgcaucuccaucuacuggaccaucgucaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacaccaagguggaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 62267 - RNA, 1701 nt, Artificial Sequence; identical to SEQ ID NO: 61641
  derived and/or modified sequence opt1 from hemagglutinin__InfluenzaA__ABI30733

SEQ ID NO: 62268 - RNA, 1701 nt, Artificial Sequence; identical to SEQ ID NO: 61641
  derived and/or modified sequence opt1 from hemagglutinin__InfluenzaA__ABI30744

SEQ ID NO: 62269 - RNA, 1701 nt, Artificial Sequence; identical to SEQ ID NO: 61641
  derived and/or modified sequence opt1 from hemagglutinin__InfluenzaA__ABI30755

SEQ ID NO: 62270 - RNA, 1701 nt, Artificial Sequence; identical to SEQ ID NO: 61641
  derived and/or modified sequence opt1 from hemagglutinin__InfluenzaA__ABI30766

SEQ ID NO: 62271 - RNA, 1701 nt, Artificial Sequence; identical to SEQ ID NO: 61641
  derived and/or modified sequence opt1 from hemagglutinin__InfluenzaA__ABI30777

SEQ ID NO: 62272 - RNA, 1701 nt, Artificial Sequence
  derived and/or modified sequence opt1 from hemagglutinin__InfluenzaA__ABI30788
augaagaccaucaucgcccugagcuacauccucugccugguguucgcccagaagcuguccggcaacgacaacagcaccgcgacgcucugccuggggcaccacgccguccccaacggcaccaucgugaagaccaucaccaacgaccagaucgaggugacgaacgccaccgagcugguccaguccagcuccaccgggggcaucugcgacagcccgcaccagauccucgacggggagaacugcacccugaucgacgcccugcucggcgacccccagugcgacggcuuccagaacaagaagugggaccuguucguggagcgcuccaaggccuacagcaacugcuaccccuacgacgugcccgacuacgcgucccugcggagccucaucgccuccagcgggacgcuggaguucaacaacgaguccuucaacuggaccggcgucacccagaacgggaccagcuccgccugcaagcgccggagcaacuccagcuucuucucccgccugaacuggcucacgcaccugaaguucaaguacccggcccugaacgugaccaugcccaacaacgaggaguucgacaagcucuacaucuggggcgugcaccaccccgggaccuacaacgaccagaucagccuguacgcgcaggccagcggccggaucaccgucuccacgaagcgcagccagcagaccgugauccccaacaucggcucccggccgcgcgugcgggacauccccagccgcaucuccaucuacuggaccaucgucaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucgaccagaucaacggcaagcugaaccggcugaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 62273 - RNA, 1701 nt, Artificial Sequence; identical to SEQ ID NO: 61641
  derived and/or modified sequence opt1 from hemagglutinin__InfluenzaA__ABI30799

SEQ ID NO: 62274 - RNA, 1701 nt, Artificial Sequence
  derived and/or modified sequence opt1 from hemagglutinin__InfluenzaA__ABI30810
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccaucaagaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 62275 - RNA, 1701 nt, Artificial Sequence
  derived and/or modified sequence opt1 from hemagglutinin__InfluenzaA__ABI30821
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacguggcgaugcccaacaacgaggaguucgacaagcucuacaucuggggcgugcaccaccccgggaccuacaacgaccagaucucccuguacgcccaggccagcggccggaucaccgucagcaccaagcgcucccagcagacggugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacccccaacggguccauccccaacgacaagccguuccagaacgugaaccgcaucacguacggcgcgugcccccgguacgugaagcagaacacccugaagcucgccaccgggaugcgcaacguccccgagaagcagacccggggcaucuucggggccaucgccggcuucaucgagaacggcugggaggggaugguggacggcugguacggguuccgccaccagaacagcgagggcaucgggcaggccgcggaccugaaguccacgcaggccgccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucacggacagcgagaugaacaagcuguucgagcggaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggcgugccagaagggcaacauccggugcaacaucugcaucuga

SEQ ID NO: 62276 - RNA, 1701 nt, Artificial Sequence; identical to SEQ ID NO: 61641
  derived and/or modified sequence opt1 from hemagglutinin__InfluenzaA__ABI30832

SEQ ID NO: 62277 - RNA, 1701 nt, Artificial Sequence
  derived and/or modified sequence opt1 from hemagglutinin__InfluenzaA__ABI30843
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggacccgcaagcagcugcgcgagaacgccgaggacaugggcaacgggugcuucaagaucuaccacaagugcgacaacgcgugcaucggcuccauccggaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 62278 - RNA, 1701 nt, Artificial Sequence; identical to SEQ ID NO: 62221
  derived and/or modified sequence opt1 from hemagglutinin__InfluenzaA__ABI30865

SEQ ID NO: 62279 - RNA, 1707 nt, Artificial Sequence
  derived and/or modified sequence opt1 from hemagglutinin__InfluenzaA__ABI36155
auggagaagaucgugcugcuccuggccaccgucagccuggugaaguccgaccagaucugcaucggcuaccacgccaacaacagcaccgagcaggucgacacgaucauggagaagaacgugaccgugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgggcugugcuaccccggcaacuucaacgacuacgaggagcugaagcaccuccugucccggaucaaccacuucgagaagcugcagaucauccccaagagcuccuggagcgaccacgaggccucccucggcgucagcuccgcgugcccguaccuggggcgcagcuccuucuuccggaacgugguguggcugaucaagaagaacaacacguaccccaccaucaagcgcagcuacaacaacaccaaccaggaggaccuccugguccuguggggcauccaccaccccaacgacgccgccgagcagacccggcucuaccagaacccgacgaccuacaucuccguggggaccagcacccugaaccagcgccuggugcccaagaucgccacgcgguccaaggucaacggccagagcgggcgcauggaguucuucuggaccauccucaagcccaacgacgcgaucaacuucgaguccaacggcaacuucaucgcccccgaguacgccuacaagaucgugaagaagggcgacagcgccaucaugaaguccgagcuggaguacggggacugcaacaccaagugccagaccccgaugggcgccaucaacagcagcaugccccugcacaacauccacccccucacgaucggggagugccccaaguacgugaaguccaaccggcugguccuggcgaccggccuccgcaacagcccgcagcgggagcgccggcgcaagaagcggggccuguucggggccaucgccggcuucaucgagggcggguggcaggggaugguggacggcugguacggcuaccaccacuccaacgagcaggggagcggcuacgccgccgacaaggaguccacccagaaggcgaucgacggggugaccaacaaggucaacagcaucaucgacaagaugaacacgcaguucgaggccgugggccgcgaguucaacaaccuggagcggcgcaucgagaaccucaacaagaagauggaggacggguuccuggacguguggaccuacaacgccgagcugcucguccugauggagaacgagcggacccuggacuuccacgacuccaacgugaagaaccucuacgacaagguccgccugcagcugcgggacaacgccaaggagcucggcaacggcugcuucgaguucuaccacaagugcgacaacgagugcauggagagcauccgcaacgggaccuacaacuacccccaguacuccgaggaggcccgccugaagcgggaggagaucagcggcgugaagcuggaguccaucgggaucuaccagauccucagcaucuacuccacgguggcgagcucccuggcccuggccaucaugauggccggccucagccuguggaugugcuccaacgggagccugcagugccgcgucugcaucuga

SEQ ID NO: 62280 - RNA, 1707 nt, Artificial Sequence
  derived and/or modified sequence opt1 from hemagglutinin__InfluenzaA__ABI36166
auggagaagaucgugcugcuccuggccaccgucagccuggugaaguccgaccagaucugcaucggcuaccacgccaacaacagcaccgagcaggucgacacgaucauggagaagaacgugaccgugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgggcugugcuaccccggcaacuucaacgacuacgaggagcugaagcaccuccugucccggaucaaccacuucgagaagcugcagaucauccccaagagcuccuggagcgaccacgaggccucccucggcgucagcuccgcgugcccguaccuggggcgcagcuccuucuuccggaacgugguguggcugaucaagaagaacaacacguaccccaccaucaagcgcagcuacaacaacaccaaccaggaggaccuccugguccuguggggcauccaccaccccaacgacgccgccgagcagacccggcucuaccagaacccgacgaccuacaucuccguggggaccagcacccugaaccagcgccuggugcccaagaucgccacgcgguccaaggucaacggccagagcgggcgcauggaguucuucuggaccauccucaagcccaacgacgcgaucaacuucgaguccaacggcaacuucaucgcccccgaguacgccuacaagaucgugaagaagggcgacagcgccaucaugaaguccgagcuggaguacggggacugcaacaccaagugccagaccccgaugggcgccaucaacagcagcaugcccuuccacaacauccacccccugacgaucggggagugccccaaguacgugaaguccaaccggcucguccuggcgaccggccugcgcaacagcccgcagcgggagcgccggcgcaagaagcggggccucuucggggccaucgccggcuucaucgagggcggguggcaggggaugguggacggcugguacggcuaccaccacuccaacgagcaggggagcggcuacgccgccgacaaggaguccacccagaaggcgaucgacggggugaccaacaaggucaacagcaucaucgacaagaugaacacgcaguucgaggccgugggccgcgaguucaacaaccuggagcggcgcaucgagaaccugaacaagaagauggaggacggguuccucgacguguggaccuacaacgccgagcugcugguccucauggagaacgagcggacccuggacuuccacgacuccaacgugaagaaccuguacgacaagguccgccuccagcugcgggacaacgccaaggagcugggcaacggcugcuucgaguucuaccacaagugcgacaacgagugcauggagagcauccgcaacgggaccuacaacuacccccaguacuccgaggaggcccgccucaagcgggaggagaucagcggcgugaagcuggaguccaucgggaucuaccagauccugagcaucuacuccacgguggcgagcucccucgcccuggccaucaugauggccggccugagccucuggaugugcuccaacgggagccugcagugccgcgucugcaucuga

SEQ ID NO: 62281 - RNA, 1707 nt, Artificial Sequence; identical to SEQ ID NO: 62280
  derived and/or modified sequence opt1 from hemagglutinin__InfluenzaA__ABI36177

SEQ ID NO: 62282 - RNA, 1707 nt, Artificial Sequence
  derived and/or modified sequence opt1 from hemagglutinin__InfluenzaA__ABI36406
auggagaagaucgugcugcuccuggccaccgucagccuggugaaguccgaccagaucugcaucggcuaccacgccaacaacagcaccgagcaggucgacacgaucauggagaagaacgugaccgugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgggcugugcuaccccggcaacuucaacgacuacgaggagcugaagcaccuccugucccggaucaaccacuucgagaagcugcagaucauccccaagagcuccuggagcgaccacgaggccucccucggcgucagcuccgcgugcccguaccuggggcgcagcuccuucuuccggaacgugguguggcugaucaagaagaacaacacguaccccaccaucaagcgcagcuacaacaacaccaaccaggaggaccuccugguccuguggggccuccaccaccccaacgacgccgccgagcagacccggcuguaccagaacccgacgaccuacaucuccguggggaccagcacccugaaccagcgccucgugcccaagaucgccacgcgguccaaggucaacggccagagcgggcgcauggaguucuucuggaccauccugaagcccaacgacgcgaucaacuucgaguccaacggcaacuucaucgcccccgaguacgccuacaagaucgugaagaagggcgacagcgccaucaugaaguccgagcuggaguacggggacugcaacaccaagugccagaccccgaugggcgccaucaacagcagcaugcccuuccacaacauccacccccucacgaucggggagugccccaaguacgugaaguccaaccggcugguccuggcgaccggccuccgcaacagcccgcagcgggagcgccggcgcaagaagcggggccuguucggggccaucgccggcuucaucgagggcggguggcaggggaugguggacggcugguacggcuaccaccacuccaacgagcaggggagcggcuacgccgccgacaaggaguccacccagaaggcgaucgacggggugaccaacaaggucaacagcaucaucgacaagaugaacacgcaguucgaggccgugggccgcgaguucaacaaccuggagcggcgcaucgagaaccucaacaagaagauggaggacggguuccuggacguguggaccuacaacgccgagcugcucguccugauggagaacgagcggacccuggacuuccacgacuccaacgugaagaaccucuacgacaagguccgccugcagcugcgggacaacgccaaggagcucggcaacggcugcuucgaguucuaccacaagugcgacaacgagugcauggagagcauccgcaacgggaccuacaacuacccccaguacuccgaggaggcccgccugaagcgggaggagaucagcggcgugaagcuggaguccaucgggaucuaccagauccucagcaucuacuccacgguggcgagcucccuggcccuggccaucaugauggccggccucagccuguggaugugcuccaacgggagccugcagugccgcgucugcaucuga

SEQ ID NO: 62283 - RNA, 1707 nt, Artificial Sequence
  derived and/or modified sequence opt1 from hemagglutinin__InfluenzaA__ABI36450
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgggaagacccacaacggcaagcugugcgaccuggacggggugaagccccucauccugcgcgacugcuccgucgccggcuggcugcucgggaacccgaugugcgacgaguucaucaacgugcccgaguggagcuacaucguggagaaggccaaccccaccaacgaccugugcuaccccggcuccuucaacgacuacgaggagcugaagcaccuccugagccggaucaaccacuucgagaagauccagaucaucccgaaguccagcugguccgaccacgaggccagcuccggcgucagcuccgccugccccuaccuggggagccccuccuucuuccgcaacgugguguggcucaucaagaagaacagcacguaccccaccaucaagaccuccuacaacaacaccaaccaggaggaccugcugguccucuggggcauccaccacagcaacgacgcggccgagcagacgcggcuguaccagaacccgaccaccuacaucuccaucgggaccagcacgcugaaccagcgccucgugcccaagaucgccacccggagcaaggugaacggccaguccgggcgcauggaguucuucuggaccauccugaagcccaacgacgccaucaacuucgagagcaacggcaacuucaucgcgcccgaguacgccuacaagaucgucaagaagggcgacuccgccaucaugaaguccgagcuggaguacgggaacugcaacaccaagugccagacgccgaugggcgccaucaacagcagcaugcccuuccacaacauccacccccucaccaucggggagugccccaaguacgugaaguccaaccggcuggugcuggccaccggccuccgcaacagcccgcagcgggagucccgccggaagaagcgcggccuguucggggcgaucgccggcuucaucgagggcggguggcaggggauggucgacggcugguacggcuaccaccacagcaacgagcagggguccggcuacgccgccgacaaggagagcacccagaaggccaucgacggggugacgaacaaggugaacuccaucaucgacaagaugaacacccaguucgaggcggucggccgggaguucaacaaccuggagcgccggaucgagaaccucaacaagaagauggaggacggguuccuggacguguggaccuacaacgccgagcugcucgugcugauggagaacgagcgcacccuggacuuccacgacagcaacgucaagaaccucuacgacaaggugcggcugcagcugcgcgacaacgccaaggagcucggcaacggcugcuucgaguucuaccacaagugcgacaacgagugcauggaguccauccggaacgggacguacaacuacccccaguacagcgaggaggcccgccugaagcgggaggagaucuccggcgucaagcuggagagcaucgggaccuaccagauccucuccaucuacagcaccguggccagcucccuggcgcuggccaucaugaucgccggccucagccuguggaugugcuccaacgggagccugcagugccgcaucugcaucuga

SEQ ID NO: 62284 - RNA, 1707 nt, Artificial Sequence
  derived and/or modified sequence opt1 from hemagglutinin__InfluenzaA__ABI49396
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgggaagacccacaacggcaagcugugcgaccuggacggggugaagccccucauccugcgcgacugcuccgucgccggcuggcugcucgggaacccgaugugcgacgaguucaucaacgugcccgaguggagcuacaucguggagaaggccaaccccaccaacgaccugugcuaccccggcuccuucaacgacuacgaggagcugaagcaccuccugagccggaucaaccacuucgagaagauccagaucaucccgaaguccagcugguccgaccacgaggccagcuccggcgucagcuccgccugccccuaccuggggagccccuccuucuuccgcaacgugguguggcucaucaagaagaacagcacguaccccaccaucaagaaguccuacaacaacaccaaccaggaggaccugcugguccucuggggcauccaccacccgaacgacgcggccgagcagacccggcuguaccagaaccccacgaccuacaucagcaucgggaccuccacccugaaccagcgccucgugcccaagaucgccacgcggagcaaggugaacggccagagcgggcgcauggaguucuucugggccauccugaagcccaacgacgcgaucaacuucgaguccaacggcaacuucaucgccccggaguacgccuacaagaucgucaagaagggcgacagcgccaucaugaaguccgagcuggaguacgggaacugcaacaccaagugccagacccccaugggcgccaucaacagcuccaugcccuuccacaacauccacccccucaccaucggggagugcccgaaguacgugaaguccaaccggcuggugcuggcgacgggccuccgcaacagcccccagcgggagagccgccggaagaagcgcggccuguucggggccaucgccggcuucaucgagggcggguggcaggggauggucgacggcugguacggcuaccaccacuccaacgagcaggggagcggcuacgccgccgacaaggaguccacccagaaggcgaucgacggggugaccaacaaggugaacagcaucaucgacaagaugaacacccaguucgaggccgucggccgggaguucaacaaccuggagcgccggaucgagaaccucaacaagaagauggaggacggguuccuggacguguggacguacaacgccgagcugcucgugcugauggagaacgagcgcacccuggacuuccacgacuccaacgucaagaaccucuacgacaaggugcggcugcagcugcgcgacaacgccaaggagcucggcaacggcugcuucgaguucuaccacaagugcgacaacgagugcauggagagcauccggaacgggaccuacaacuacccccaguacuccgaggaggcccgccugaagcgggaggagaucagcggcgucaagcuggaguccaucgggaccuaccagauccucagcaucuacuccacgguggcgagcagccuggcccuggccaucaugaucgccggccucucccuguggaugugcagcaacgggucccugcagugccgcaucugcaucuga

SEQ ID NO: 62285 - RNA, 1704 nt, Artificial Sequence
  derived and/or modified sequence opt1 from hemagglutinin__InfluenzaA__ABI85000
augaacacccagauccuggccuucaucgccugcaugcucaucggcaccaagggggacaagaucugccugggccaccacgcgguggccaacgggacgaaggucaacacccugaccgagcgcggcaucgagguggugaacgccaccgagacggucgagaccgugaacaucaagaagaucugcacccaggggaagcggcccaccgaccucggccagugcggccugcuggggacgcucaucggcccgccccagugcgaccaguuccuggaguucgacgccaaccugaucaucgagcgccgggaggggaccgacgugugcuaccccggcaaguucaccaacgaggagagccuccgccagauccugcggggguccggcggcaucgacaaggagagcaugggguucaccuacuccggcauccgcacgaacggggccaccagcgcgugccggcgcuccggcagcuccuucuacgccgagaugaaguggcugcucagcaacuccgacaacgccgccuucccccagaugaccaagagcuaccggaacccgcgcaacaagcccgcgcugaucaucuggggcguccaccacuccgggagcgccaccgagcagacgaagcuguacggcuccgggaacaagcucaucaccgugggcagcuccaaguaccagcagagcuucacccccucccccggggcccggccccaggugaacggccagagcggccgcaucgacuuccacuggcugcugcucgacccgaacgacaccgucacguucaccuucaacggggccuucaucgcccccgaccgggcguccuucuuccgcggcgagagccugggggugcagagcgacgugccccuggacuccggcugcgagggggacugcuuccacagcggcggcaccaucgucuccagccucccguuccagaacaucaacccccggaccguggggaagugcccccgcuacgugaagcagacgucccugcugcucgccaccggcaugcggaacguccccgagaacccgaagcaggccuaccagaagcgcaugacccgggggcuguucggcgccaucgccggguucaucgagaacggcugggagggccugaucgacgggugguacggcuuccgccaccagaacgcgcagggggagggcaccgccgccgacuacaagagcacgcaguccgccaucgaccagaucaccggcaagcucaaccggcugaucgacaagaccaaccagcaguucgagcugaucgacaacgaguucagcgagaucgagcagcagaucgggaacgugaucaacuggacccgcgacuccaugacggagguguggagcuacaacgccgagcuccuggucgcgauggagaaccagcacaccaucgaccuggccgacuccgagaugaacaagcucuacgagcgcgugcggaagcagcugcgcgagaacgccgaggaggacggcaccgggugcuucgagaucuuccacaagugcgacgaccagugcauggagagcauccggaacaacaccuacgaccacacgcaguaccgcaccgagucccugcagaaccggauccagaucgaccccgugaagcucagcuccggcuacaaggacaucauccugugguucagcuucggggccuccugcuuccugcuccuggccaucgcgaugggccuggucuucaucugcaucaagaacggcaacaugcgcugcaccaucugcaucuga

SEQ ID NO: 62286 - RNA, 1701 nt, Artificial Sequence; identical to SEQ ID NO: 61838
  derived and/or modified sequence opt1 from hemagglutinin__InfluenzaA__ABI92291

SEQ ID NO: 62287 - RNA, 1701 nt, Artificial Sequence
  derived and/or modified sequence opt1 from hemagglutinin__InfluenzaA__ABI92302
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagagcuccuggccgaagcacaacgucacccgcggggugacggccagcugcucccacaagggcaagagcuccuucuaccggaaccuccuguggcugaccgagaagaacgggagcuaccccaaccucagcaaguccuacgugaacaacaaggagaaggagguccuggugcuguggggcgugcaccaccccagcaacaucgaggaccagaagaccaucuaccggaaggagaacgccuacgucuccguggugagcucccacuacaaccgccgguucacccccgagaucgcgaagcgcccgaagguccgggaccaggaggggcgcaucaacuacuacuggacgcuccuggagcccggcgacaccaucaucuucgaggccaacggcaaccugaucgcccccugguacgccuucgcccucagccggggguucggcuccgggaucaucaccagcaacgcguccauggacgagugcgacgccaagugccagacgccccagggcgccaucaacagcucccugccguuccagaacgugcaccccgugaccaucggcgagugccccaaguacguccgcagcaccaagcugcggauggugaccgggcuccgcaacauccccuccauccagagccggggccuguucggggccaucgccggcuucaucgagggcggcuggaccggcaugaucgacgggugguacggcuaccaccaccagaacgagcagggguccggcuacgcggccgaccagaaguccacgcagaacgccaucaacgggaucaccaacaaggugaacagcgucaucgagaagaugaacauccaguucaccgccgugggcaaggaguucaacaagcuggagaagcgcauggagaaccucaacaagaagguggacgacggcuuccuggacaucuggaccuacaacgccgagcugcucguccugcuggagaacgagcggacgcucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuacccgaaguacagcgaggaguccaagcucaaccgcgagaagaucgacggcgugaagcuggagagcaugggggucuaccagauccuggccaucuacuccaccguggccagcucccucgugcugcuggucagccucggcgccaucuccuucuggaugugcagcaacggcucccugcagugccggaucugcaucuga

SEQ ID NO: 62288 - RNA, 1701 nt, Artificial Sequence
  derived and/or modified sequence opt1 from hemagglutinin__InfluenzaA__ABI92313
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccaucagcuccuucgagcgcuucgagaucuucccgaaggagagcuccuggcccaaccacaccgucaccaagggggugaccgccagcugcucccacaacggcaagagcuccuucuacaagaaccugcucuggcugacggagaagaacgggcuguaccccaaccucagcaaguccuacgugaacaacaaggagaaggagguccuggugcuguggggcgugcaccaccccagcaacaucggggaccagcgggccaucuaccacaccgagaacgcguacgucagcgugguguccagccacuacucccgccgguucaccccggagaucaccaagcgccccaagguccgggaccaggagggccgcaucaacuacuacuggacgcuccuggagcccggcgacaccaucaucuucgaggccaacgggaaccugaucgcccccugguacgccuucgcccucagccggggcuucggguccggcaucaucaccagcaacgcguccaugggcgagugcgacgccaagugccagaccccgcagggggccaucaacagcucccugcccuuccagaacgugcaccccgugacgaucggcgagugccccaaguacguccgcagcaccaagcugcggauggugaccgggcuccgcaacaucccguccauccagagccggggccuguucggggccaucgccggcuucaucgagggcggguggaccggcaugaucgacgggugguacggcuaccaccaccagaacgagcagggguccggcuacgcggccgaccagaaguccacgcagaacgccaucgacggcaucaccaacaaggugaacagcgucaucgagaagaugaacacccaguucaccgccguggggaaggaguucaacaagcuggagcgccggauggagaaccucaacaagaagguggacgacggcuuccuggacaucuggacguacaacgccgagcugcucguccugcuggagaacgagcgcacccucgacuuccacgacagcaacgugaagaaccuguacgagaaggucaagaaccagcugaagaacaacgcgaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgugaagcuggagagcaugggcgucuaccacauccuggccaucuacagcaccguggccuccagccucgugcugcuggucucccucggggccaucagcuucuggaugugcuccaacggcagccugcagugccgcaucugcaucuga

SEQ ID NO: 62289 - RNA, 1701 nt, Artificial Sequence
  derived and/or modified sequence opt1 from hemagglutinin__InfluenzaA__ABI92324
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggaaggucaccgugagcaccaagcggagccagcagaccgugaucccgaacaucggcuuccgccccuggguccgggggcucuccagccgcaucuccaucuacuggacgaucgugaagcccggcgacauccugcugaucaacagcaccgggaaccucaucgcgccccggggcuacuucaagauccgcaacggcaaguccagcaucaugcgguccgacgccccgaucgggaacugcagcuccgagugcaucacccccaacggcagcauccccaacgacaagcccuuccagaacgugaaccgcaucaccuacggggccugcccgcgguacgucaagcagaacacgcugaagcuggccaccggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccucaagagcacgcaggcggccaucgaccagaucaacggcaagcugaaccggcugaucgagaagaccaacgagaaguuccaccagaucgagaaggaguucuccgaggucgaggggcgcauccaggaccucgagaaguacguggaggacaccaagaucgaccuguggagcuacaacgccggccugcucguggcccuggagaaccagcacaccaucgaccugacggacuccgagaugaacaagcuguucgagcggacccgcaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgguuccagaucaagggcguggagcucaaguccggguacaaggacuggauccuguggaucagcuucgccaucuccugcuuccugcucugcgucgugcugcugggcuucaucaugugggccugccagaaggggaacauccgcugcaacaucugcaucuga

SEQ ID NO: 62290 - RNA, 1701 nt, Artificial Sequence
  derived and/or modified sequence opt1 from hemagglutinin__InfluenzaA__ABI92335
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagccuguacgcgcaggccagcggccgcgugaccgucuccaccaagcggagccagcagaccgugaucccgaacaucgggucccgccccugggugcggggcgucagcucccgcaucagcaucuacuggacgaucgugaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggguucaucgagaacggcugggagggcaugauggacgggugguacggcuuccgccaccagaacagcgaggggaccggccaggccgccgaccugaaguccacgcaggcggccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacaugggcaacgggugcuucaagaucuaccacaagugcgacaacgcgugcaugggcuccauccgcaacgggaccuacgaccacgacguguaccgggacgaggcccugaacaaccgcuuccagaucaagggcgucgagcucaagagcggguacaaggacuggauccuguggaucagcuucgccaucuccugcuuccugcugugcaucgugcucaugggcuucaucaugugggccugccagaagggcaacauccggugcaacaucugcaucuga

SEQ ID NO: 62291 - RNA, 1701 nt, Artificial Sequence
  derived and/or modified sequence opt1 from hemagglutinin__InfluenzaA__ABI92346
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccacaucaagggggucgagcugaaguccggcuacaaggacugggugcucuggaucagcuucgccaucagcugcuuccugcugugcaucguccuccugggcuucaucaugugggccugccagaaggggaacauccggugcaacaucugcaucuga

SEQ ID NO: 62292 - RNA, 1701 nt, Artificial Sequence; identical to SEQ ID NO: 61290
  derived and/or modified sequence opt1 from hemagglutinin__InfluenzaA__ABI92357

SEQ ID NO: 62293 - RNA, 1701 nt, Artificial Sequence; identical to SEQ ID NO: 61290
  derived and/or modified sequence opt1 from hemagglutinin__InfluenzaA__ABI92368

SEQ ID NO: 62294 - RNA, 1698 nt, Artificial Sequence; identical to SEQ ID NO: 62212
  derived and/or modified sequence opt1 from hemagglutinin__InfluenzaA__ABI92379

SEQ ID NO: 62295 - RNA, 1701 nt, Artificial Sequence
  derived and/or modified sequence opt1 from hemagglutinin__InfluenzaA__ABI92390
augaagaccaucaucgccuucagcuacauccugugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccuggucgccagcuccgggacgcucgaguucaacaacgagagcuucaacuggaccggcgugacccagaacgggaccuccagcgccugcaagcgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccgacaacgaccagaccagccucuacgcgcaggccuccggccggaucacggugagcaccaagcgcagccagcagaccgugaccccgaacaucggcucccggccccgcguccgggacauccccagccgcaucuccaucuacuggacgaucgugaagcccggggacauccugcugaucaacagcaccggcaaccucaucgccccgcggggguacuucaagauccgcuccggcaagagcuccaucaugcggagcgacgcccccaucggcaagugcaacuccgagugcaucacccccaacgggagcauccccaacgacaagccguuccagaacgugaaccgcaucaccuacggcgccugcccccgguacgucaagcagaacacgcugaagcuggcgaccgggaugcgcaacgugcccgagaagcagacccggggcaucuucggggccaucgccggcuucaucgagaacggcugggaggggaugguggacggcugguacggguuccgccaccagaacuccgagggcaccgggcaggccgccgaccucaagagcacgcaggcggccaucaaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 62296 - RNA, 1701 nt, Artificial Sequence; identical to SEQ ID NO: 61290
  derived and/or modified sequence opt1 from hemagglutinin__InfluenzaA__ABI92401

SEQ ID NO: 62297 - RNA, 1701 nt, Artificial Sequence
  derived and/or modified sequence opt1 from hemagglutinin__InfluenzaA__ABI92412
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccagugcgacggcuuccagaacaagaagugggaccuguucguggagcgcagcaaggccuacuccaacugcuaccccuacgacgugccggacuacgcgagccuccggucccugaucgccagcuccgggacgcuggaguucaacaacgagagcuucaacuggaccggcgucacccagaacgggaccuccagcgccugcaagcgccgguccaacagcuccuucuucagccgccucaacuggcugacgcaccugaaguucaaguaccccgcccucaacgugaccaugcccaacaacgaggaguucgacaagcuguacaucuggggcgugcaccaccccgggaccuacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccuccugaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacaucaaccgcaucaccuacggcgccugcccccgguacgugaagcagaacacccucaagcuggcgaccgggaugcgcaacgugcccgagaagcagacgcggggcaucuucggggccaucgccggcuucaucgagaacggcugggaggggauggucgacggcugguacggguuccgccaccagaacagcgagggcaucgggcaggccgccgaccugaaguccacccaggcggccaucgaccagaucaacggcaagcucaaccggcugaucggcaagaccaacgagaaguuccaccagaucgagaaggaguucagcgagguggaggggcgcauccaggaccuggagaaguacguggaggacaccaagaucgaccucugguccuacaacgccgagcugcuggucgcccucgagaaccagcacacgaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcguggagcugaaguccggcuacaaggacuggauccucuggaucuccuucgccaucagcugcuuccugcugugcgucgcccuccugggguucaucaugugggccugccagaagggcaacauccggugcaacaucugcaucuga

SEQ ID NO: 62298 - RNA, 1701 nt, Artificial Sequence
  derived and/or modified sequence opt1 from hemagglutinin__InfluenzaA__ABI92423
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgacaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62299 - RNA, 1701 nt, Artificial Sequence; identical to SEQ ID NO: 61641
  derived and/or modified sequence opt1 from hemagglutinin__InfluenzaA__ABI92434

SEQ ID NO: 62300 - RNA, 1701 nt, Artificial Sequence
  derived and/or modified sequence opt1 from hemagglutinin__InfluenzaA__ABI92445
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccgggggcaucugcgacagcccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgccagccugcggucccucaucgcgagcuccgggacccuggaguucaacaacgagagcuucaacuggaccggcgucaaccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcccaggcgagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgccaccgggaugcgcaacguccccgagaagcagacgcggggcaucuucggggcgaucgccggcuucaucgagaacggcugggaggggaugguggacggcugguacggguuccgccaccagaacagcgagggcaucgggcaggccgccgaccugaaguccacccaggccgcgaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacacgugcaucggcuccauccgcaacgggaccuacgaccacgacguguaccgggacgaggcccucaacaaccgcuuccagaucaagggcgucgagcugaaguccggcuacaaggacuggauccuguggaucuccuucgcgaucagcugcuuccuccugugcguggcccugcucggguucaucaugugggccugccagaagggcaacauccggugcaacaucugcaucuga

SEQ ID NO: 62301 - RNA, 1701 nt, Artificial Sequence; identical to SEQ ID NO: 61641
  derived and/or modified sequence opt1 from hemagglutinin__InfluenzaA__ABI92456

SEQ ID NO: 62302 - RNA, 1701 nt, Artificial Sequence; identical to SEQ ID NO: 62249
  derived and/or modified sequence opt1 from hemagglutinin__InfluenzaA__ABI92467

SEQ ID NO: 62303 - RNA, 1701 nt, Artificial Sequence; identical to SEQ ID NO: 61658
  derived and/or modified sequence opt1 from hemagglutinin__InfluenzaA__ABI92478

SEQ ID NO: 62304 - RNA, 1701 nt, Artificial Sequence; identical to SEQ ID NO: 62249
  derived and/or modified sequence opt1 from hemagglutinin__InfluenzaA__ABI92489

SEQ ID NO: 62305 - RNA, 1701 nt, Artificial Sequence
  derived and/or modified sequence opt1 from hemagglutinin__InfluenzaA__ABI92500
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccuccugaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgugaucaaccagaucaacggcaagcucaaccgccugaucgagaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggcuucaucaugugggccugccagaaggggaacauccgcugcaacaucugcaucuga

SEQ ID NO: 62306 - RNA, 1701 nt, Artificial Sequence
  derived and/or modified sequence opt1 from hemagglutinin__InfluenzaA__ABI92511
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagaacagcuccaccgggaucaucugcgacagcccccaccagauccuggacggcgagaacugcacccugaucgacgcccuccugggggacccccacugcgacggcuuccagaacaaggagugggaccuguucguggagcgcuccaaggccuacagcaacugcuaccccuacgacgugccggacuacgcgucccuccggagccuggucgccuccagcggcacgcuggaguucaacaacgaguccuucaacuggaccgggguggcccagaacggcaccagcuccgccugcaagcgccggagcgacaaguccuucuucagccgccucaacuggcugcaccagcugaaguacaaguaccccgcgcucaacgugaccaugcccaacacggagaaguucgacaagcuguacaucuggggcguccaccaccccuccaccgacagcgaccagaucucccuguacgcccaggccagcgggcgggugaccgugagcaccaagcgcucccagcagacggucaucccgaacaucgggagccggcccugggugcgcggcguguccagccgggucuccaucuacuggaccaucgugaagcccggcgacauccuccugaucaacagcaccgggaaccugaucgcgccccgcggcuacuucaagauccgguccggcaagagcuccaucaugcgcagcgacgccuccaucgggaagugcaacagcaagugcaucaccccgaacggcuccauccccaacgacaagcccuuccagaacgugaaccggaucacguacggggccugcccccgcuacgucaagcagaacacccucaagcuggccaccggcaugcggaacgugccggagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcucaaccgccugaucgagaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagcgcaccaagaagcagcuccgggagaacgcggaggacaugggcaacgggugcuucaagaucuaccacaagugcgacaacacgugcaucggcuccauccgcaacgggaccuacgaccacgacgucuaccgcgacgaggcccugaacaaccgguuccagaucaagggcguggagcucaagagcggguacaaggacuggauccuguggaucagcuucgccaucuccugcuuccugcugugcgucgugcuccugggcuucaucaugugggccugccagaagggcaacauccgcugcaacaucugcaucuga

SEQ ID NO: 62307 - RNA, 1701 nt, Artificial Sequence
  derived and/or modified sequence opt1 from hemagglutinin__InfluenzaA__ABI92522
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugaaguccgacgccccgaucggcaagugcaacuccgagugcaucacccccaacgggagcauccccaacgacaagcccuuccagaacgugaaccggaucaccuacggcgccugcccgcgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccucaagagcacgcaggcggccaucaaccagaucaacggcaagcugaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcaucgugcuccugggcuucaucaugugggccugccagaaggggaacauccgcugcaacaucugcaucuga

SEQ ID NO: 62308 - RNA, 1701 nt, Artificial Sequence
  derived and/or modified sequence opt1 from hemagglutinin__InfluenzaA__ABI92533
augaagaccaucaucgcccugagcuacauccucugccugguguucgcccagaagcugcccggcaacgacaacucccgcgcgacccucugccuggggcaccacgccgucccgaacggcacgcuggugaagaccaucaccaacgaccagaucgaggugaccaacgccacggagcucguccagagcuccagcaccgggcggaucugcgacagcccccaccagauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgucagccuccggucccugguggcgagcuccggcacccuggaguucaacaacgagagcuucaacuggacggggguggcccagaacggcaccuccagcgccugcaagcgccgguccgacaagagcuucuucucccgccucaacuggcugcaccagcugaaguacaaguaccccgcccucaacgucaccaugcccaacaacgagaaguucgacaagcuguacaucuggggcgugcaccaccccgggaccgacagcgaccagaucucccuguacgcgcaggccagcgggcgggugacggucagcaccaagcgcucccagcagaccgugaucccgaacaucggcagccggcccugggugcgcggcgucuccagccggaucuccaucuacuggaccaucgugaagcccggggacauccuccugaucaacagcacgggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcccgugcccccgcuacgucaagcagaacacccucaagcuggccacggggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacccaggccgcgaucaaccagaucaacggcaagcucaaccgccugaucgagaagacgaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugaccgacuccgagaugaacaagcuguucgagcgcacgaagaagcagcuccgcgagaacgccgaggacauggggaacggcugcuucaagaucuaccacaagugcgacaacgccugcaucgggagcauccggaacggcaccuacgaccacgacguguaccgcgacgaggcgcugaacaaccgguuccagaucaagggggucgagcugaaguccggcuacaaggacuggauccucuggaucagcuucgccaucagcugcuuccugcugugcaucgugcuccugggcuucaucaugugggccugccagaaggggaacauccgcugcaacaucugcaucuga

SEQ ID NO: 62309 - RNA, 1701 nt, Artificial Sequence; identical to SEQ ID NO: 62308
  derived and/or modified sequence opt1 from hemagglutinin__InfluenzaA__ABI92544

SEQ ID NO: 62310 - RNA, 1701 nt, Artificial Sequence
  derived and/or modified sequence opt1 from hemagglutinin__InfluenzaA__ABI92577
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagccgcgccuacuccaacugcuaccccuacgacgugccggacuacgucagccuccggucccugguggcgagcuccggcacgcuggaguucaacaacgagagcuucaacuggaccgggguggcccagaacggcaccuccagcgccugcaagcgccgguccgacaagagcuucuucucccgccucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgggugaccgucagcaccaagcgcucccagcagaccgugaucccgaacaucggcagccggcccugggugcgcggcgucuccagcaagaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaaggacuggauccucuggaucagcuucgccaucagcugcuuccugcugugcaucgugcuccugggcuucaucaugugggccugccagaaggggaacauccggugcaacaucugcaucuga

SEQ ID NO: 62311 - RNA, 1701 nt, Artificial Sequence; identical to SEQ ID NO: 62047
  derived and/or modified sequence opt1 from hemagglutinin__InfluenzaA__ABI92588

SEQ ID NO: 62312 - RNA, 1701 nt, Artificial Sequence
  derived and/or modified sequence opt1 from hemagglutinin__InfluenzaA__ABI92599
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcaacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaagacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcaucgugcuccugggcuucaucaugugggccugccagaaggggaacauccggugcaacaucugcaucuga

SEQ ID NO: 62313 - RNA, 1701 nt, Artificial Sequence
  derived and/or modified sequence opt1 from hemagglutinin__InfluenzaA__ABI92610
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcaucgugcuccugggcuucaucaugugggccugccagaaggggaacauccggugcaacaucugcaucuga

SEQ ID NO: 62314 - RNA, 1701 nt, Artificial Sequence
  derived and/or modified sequence opt1 from hemagglutinin__InfluenzaA__ABI92621
augaagaccaucaucgcccugagcuacauccucugccugguguucgcccagaagcugcccggcaacgacaacuccauggcgacccucugccuggggcaccacgccgucccgaacggcacgcuggugaagaccaucaccaacgaccagaucgaggugaccaacgccacggagcucguccagagcuccagcaccgggcgcaucugcaacagcccccaccagauccuggacggcgagaacugcacccugaucgacgcccuccugggggacccccacugcgagggcuuccagaacaaggagugggaccuguucguggagcgguccaaggccuacuccaacugcuaccccuacgacgugccggacuacgucagccuccgcucccugguggcgagcuccggcacccuggaguucaacaacgagagcuucaacuggacggggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggaccgacagcgaccagaucucccuguacgcgcaggccagcgggcgcgugacggucagcaccaagcggucccagcagaccgugaucccgaacaucggcagccgccccugggugcggggcgucuccagcaagaucuccaucuacuggaccaucgugaagcccggggacauccuccugaucaacagcacgggcaaccugaucgcgccccgcggguacuucaagauccgguccggcaagagcuccaucaugcgcagcgacgccccgaucgacaagugcaacuccgagugcaucacccccaacggcagcauccccaacgacaagcccuuccagaacgugaaccggaucaccuacgggcucugcccgcgcuacgucaagcagaacacccugaagcuggccacgggcaugcggaacgugcccgagaagcagacccgcgggaucuucggcgccaucgccggguucaucgagaacggcugggagggcaugauggacgggugguacggcuuccggcaccagaacuccgaggggaccggccaggccgccgaccucaagagcacccaggccgcgaucaaccagaucaacgggaagcugaaccgccugaucgagaagacgaacgagaaguuccaccagaucgagaaggaguucuccgagguggagggccggauccaggaccucgagaaguacgucgaggacaccaagaucgaccuguggagcuacaacgccgagcugcucguggcccuggagaaccagcacaccaucgaccugaccgacuccgagaugaacaagcuguucgagcgcacgaagaagcagcuccgggagaacgccgaggacaugggcaacgggugcuucaagaucuaccacaagugcgacaacgccugcaucggcagcauccgcaacgggaccuacgaccacgacguguaccgcgacgaggcgcugaacaaccgguuccagaucaagggcgucgagcucaaguccggguacaaggacuggauccuguggaucagcuucgccaucagcugcuuccugcucugcaucgugcugcugggcuucaucaugugggccugccagaagggcaacauccgcugcaacaucugcaucuga

SEQ ID NO: 62315 - RNA, 1701 nt, Artificial Sequence; identical to SEQ ID NO: 61570
  derived and/or modified sequence opt1 from hemagglutinin__InfluenzaA__ABI92632

SEQ ID NO: 62316 - RNA, 1701 nt, Artificial Sequence
  derived and/or modified sequence opt1 from hemagglutinin__InfluenzaA__ABI92643
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccauccccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagcgccagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucagcuucgccaucagcugcuuccuccugugcgucgcccugcucggguucaucaugugggccugccagaagggcaacauccgcugcaacaucugcaucuga

SEQ ID NO: 62317 - RNA, 1701 nt, Artificial Sequence
  derived and/or modified sequence opt1 from hemagglutinin__InfluenzaA__ABI92665
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgcggcuccaacaagagcuucuucucccggcugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccgcaucaccgugagcacgaagcggucccagcagaccgugaucccgaacaucgggagccgcccccggguccgcgacguguccagccggaucuccaucuacuggaccaucgugaagcccggcgacauccugcucaucaacagcaccgggaaccugaucgcgccccgcggcuacuucaagauccgguccggcaagagcuccaucaugcgcagcgacgccccgaucgggaagugcaacuccgagugcaucacgcccaacggcagcauccccaacgacaagcccuuccagaacgucaaccggaucaccuacggggccugcccgcgcuacgugaagcagaacacccugaagcucgccaccggcaugcggaacgugcccgagaagcagacgcgcgggaucuucggcgccaucgccggcuucaucgagaacgggugggagggcauggucgacgggugguacggcuuccggcaccagaacuccgaggggaccggccaggccgccgaccugaaguccacccaggcggccaucaaccagaucaacggcaagcugaaccgccucaucgggaagaccaacgagaaguuccaccagaucgagaaggaguucuccgagguggagggccggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagcggcagcugcgcgagaacgccgaggacauggggaacggcugcuucaagaucuaccacaagugcgacaacgcgugcaucgggagcauccgcaacggcacguacgaccacgacguguaccggaacgaggcccucaacaaccgcuuccagaucaagggcguggagcugaaguccggguacaaggacuggauccuguggaucagcuucgccaucagcugcuuccuccugugcgucgcccugcucggcuucaucaugugggccugccagaaggggaacauccggugcaacaucugcaucuga

SEQ ID NO: 62318 - RNA, 1701 nt, Artificial Sequence
  derived and/or modified sequence opt1 from hemagglutinin__InfluenzaA__ABI92676
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcaacggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 62319 - RNA, 1701 nt, Artificial Sequence
  derived and/or modified sequence opt1 from hemagglutinin__InfluenzaA__ABI92687
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgcggcuccaacaagagcuucuucucccggcugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccgcaucaccgugagcacgaagcggucccagcagaccgugaucccgaacaucgggagccgcccccggguccgcgacguguccagccggaucuccaucuacuggaccaucgugaagcccggcgacauccugcucaucaacagcaccgggaaccugaucgcgccccgcggcuacuucaagauccgguccggcaagagcuccaucaugcgcagcgacgccccgaucgggaagugcaacuccgagugcaucacgcccaacggcagcauccccaacgacaagcccuuccagaacgucaaccggaucaccuacggggccugcccgcgcuacgugaagcagaacacccugaagcucgccaccggcaugcggaacgugcccgagaagcagacgcgcgggaucuucggcgccaucgccggcuucaucgagaacgggugggagggcauggucgacgggugguacggcuuccggcaccagaacuccgaggggaccggccaggccgccgaccugaaguccacccaggcggccaucaaccagaucaacggcaagcugaaccgccucaucgggaagaccaacgagaaguuccaccagaucgagaaggaguucuccgagguggagggccggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagcggcagcugcgcgagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaagggcguggagcugaaguccggguacaaggacuggauccuguggaucagcuucgccaucagcugcuuccuccugugcgucgcccugcucggcuucaucaugugggccugccagaaggggaacauccggugcaacaucugcaucuga

SEQ ID NO: 62320 - RNA, 1701 nt, Artificial Sequence; identical to SEQ ID NO: 62319
  derived and/or modified sequence opt1 from hemagglutinin__InfluenzaA__ABI92698

SEQ ID NO: 62321 - RNA, 1701 nt, Artificial Sequence; identical to SEQ ID NO: 61524
  derived and/or modified sequence opt1 from hemagglutinin__InfluenzaA__ABI92709

SEQ ID NO: 62322 - RNA, 1701 nt, Artificial Sequence
  derived and/or modified sequence opt1 from hemagglutinin__InfluenzaA__ABI92720
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgagagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 62323 - RNA, 1701 nt, Artificial Sequence
  derived and/or modified sequence opt1 from hemagglutinin__InfluenzaA__ABI92731
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagcgccagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucagcuucgccaucagcugcuuccuccugugcgucgcccugcucggguucaucaugugggccugccagaagggcaacauccgcugcaacaucugcaucuga

SEQ ID NO: 62324 - RNA, 1701 nt, Artificial Sequence
  derived and/or modified sequence opt1 from hemagglutinin__InfluenzaA__ABI92742
augaagaccaucaucgcccugagcuacauccucugccugguguucucccagaagcugcccggcaacgacaacagcaccgccacgcucugccuggggcaccacgcggucccgaacggcaccaucgugaagaccaucaccaacgaccagaucgaggugacgaacgccaccgagcugguccaguccagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggaccacgccucccugcggagccucgucgcguccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcccaggcgagcggccggaucaccguguccacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggccgcgaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgccugcaucggcuccauccgcaacgggacguacgaccacgacguguaccgggacgaggcgcucaacaaccgcuuccagaucaagggcguggagcucaagagcggcuacaaggacuggauccuguggaucagcuucgccaucuccugcuuccugcugugcgucgcccugcucggguucaucaugugggccugccagaagggcaacauccggugcaacaucugcaucuga

SEQ ID NO: 62325 - RNA, 1701 nt, Artificial Sequence
  derived and/or modified sequence opt1 from hemagglutinin__InfluenzaA__ABI92753
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcguaccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagcgccagcugcgcgagaacgccgaggacaugggcaacgggugcuucaagaucuaccacaagugcgacaacgcgugcaucggcuccauccggaacgggacguacgaccacgacguguaccgcgacgaggcccucaacaaccgguuccagaucaagggcguggagcugaaguccggcuacaaggacuggauccuguggaucuccuucgccaucagcugcuuccuccugugcgucgcccugcucggguucaucaugugggccugccagaagggcaacauccgcugcaacaucugcaucuga

SEQ ID NO: 62326 - RNA, 1701 nt, Artificial Sequence
  derived and/or modified sequence opt1 from hemagglutinin__InfluenzaA__ABI92764
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucgacuggaccggggugacccagaacggcaccuccagcgccugcaagcgcggguccaacaagagcuucuucucccggcugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccgcaucaccgugagcacgaagcggucccagcagaccgugaucccgaacaucggcagccgcccccggguccgcgacguguccagccggaucuccaucuacuggaccaucgugaagcccggggacauccugcucaucaacagcaccggcaaccugaucgcgccccgcggguacuucaagauccgguccggcaagagcuccaucaugcgcagcgacgccccgaucggcaagugcaacuccgagugcaucacgcccaacgggagcauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagcggcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 62327 - RNA, 1701 nt, Artificial Sequence; identical to SEQ ID NO: 62319
  derived and/or modified sequence opt1 from hemagglutinin__InfluenzaA__ABI92775

SEQ ID NO: 62328 - RNA, 1701 nt, Artificial Sequence; identical to SEQ ID NO: 61251
  derived and/or modified sequence opt1 from hemagglutinin__InfluenzaA__ABI92786

SEQ ID NO: 62329 - RNA, 1701 nt, Artificial Sequence
  derived and/or modified sequence opt1 from hemagglutinin__InfluenzaA__ABI92797
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucuccaacaucggcagccggccgcgcguccgggacauccccucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62330 - RNA, 1701 nt, Artificial Sequence; identical to SEQ ID NO: 61251
  derived and/or modified sequence opt1 from hemagglutinin__InfluenzaA__ABI92808

SEQ ID NO: 62331 - RNA, 1701 nt, Artificial Sequence; identical to SEQ ID NO: 61251
  derived and/or modified sequence opt1 from hemagglutinin__InfluenzaA__ABI92819

SEQ ID NO: 62332 - RNA, 1701 nt, Artificial Sequence; identical to SEQ ID NO: 61251
  derived and/or modified sequence opt1 from hemagglutinin__InfluenzaA__ABI92841

SEQ ID NO: 62333 - RNA, 1701 nt, Artificial Sequence
  derived and/or modified sequence opt1 from hemagglutinin__InfluenzaA__ABI92852
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcuaccggccccgcguccgggacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62334 - RNA, 1701 nt, Artificial Sequence
  derived and/or modified sequence opt1 from hemagglutinin__InfluenzaA__ABI92863
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggcccacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaaccagagcuucuucucccgccugaacuggcucacgcaccugaaguucaaguaccccgcccugaacgugaccaugcccaacaacgagaaguucgacaagcucuacaucuggggcgugcaccaccccgggaccgacagcgaccagaucucccuguacgcgcaggccccgggccggaucaccgucagcacgaagcgcagccagcagaccgugauccccaacaucggcucccggccccgcgugcgggacaucagcucccgcaucagcaucuacuggaccaucgucaagcccggggacauccugcucaucaacuccaccggcaaccugaucgccccgcggggguacuucaagauccgcagcggcaaguccagcaucaugaaguccgacgcccccaucggccggugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcgucgagcugaaguccggcuacaaggacuggauccuguggaucuccuucgccaucagcugccuccugcugugcguggcccuccugggguucaucaugugggccugccagaagggcaacauccggugcaacaucugcaucuga

SEQ ID NO: 62335 - RNA, 1701 nt, Artificial Sequence; identical to SEQ ID NO: 61251
  derived and/or modified sequence opt1 from hemagglutinin__InfluenzaA__ABI92874

SEQ ID NO: 62336 - RNA, 1701 nt, Artificial Sequence; identical to SEQ ID NO: 61251
  derived and/or modified sequence opt1 from hemagglutinin__InfluenzaA__ABI92885

SEQ ID NO: 62337 - RNA, 1701 nt, Artificial Sequence
  derived and/or modified sequence opt1 from hemagglutinin__InfluenzaA__ABI92907
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacucccccuaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgucagccugcggucccucguggcgagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucagccuguacgcccaggcguccggccggaucaccgugagcacgaagcgcagccagcagaccgucaucccgaacaucggcucccggccccgcgugcgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgccaccgggaugcgcaacgugcccgagaagcagacgcggggcaucuucggggcgaucgccggcuucaucgagaacggcugggaggggauggucgacggcugguacggguuccgccaccagaacuccgagggcaucgggcaggccgccgaccucaagagcacccaggccgcgaucaaccagaucaacggcaagcugaaccggcugaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 62338 - RNA, 1701 nt, Artificial Sequence; identical to SEQ ID NO: 61251
  derived and/or modified sequence opt1 from hemagglutinin__InfluenzaA__ABI92918

SEQ ID NO: 62339 - RNA, 1701 nt, Artificial Sequence; identical to SEQ ID NO: 62337
  derived and/or modified sequence opt1 from hemagglutinin__InfluenzaA__ABI92929

SEQ ID NO: 62340 - RNA, 1701 nt, Artificial Sequence
  derived and/or modified sequence opt1 from hemagglutinin__InfluenzaA__ABI92940
augaagaccaucaucgccuucaacuacauccugugccucguguucgcccagaagcugcccggcaacgacaacagcaccgcgacgcugugccucgggcaccacgccgucccgaacggcaccaucgugaagaccaucaccaacgaccagaucgaggugacgaacgccaccgagcugguccaguccagcuccaccgggggcaucugcgacagcccccaccagauccuggacggggagaacugcacccucaucgacgcccugcugggcgacccccagugcgacggcuuccagaacaagaagugggaccucuucguggagcgcuccaaggccuacagcaacugcuaccccuacgacgugccggacuacgcgucccugcggagccuggucgccuccagcgggacgcucgaguucaacaacgagaucuucaacuggaccggcgugacccagaacgggaccuccagcgccugcaagcgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccgacaacgaccagaucagccucuacgcgcaggccuccggccggaucaccgugagcacgaagcgcucccagcagaccgugaucccgaacaucggcagccggccccgcguccgggacauccccagccgcaucuccaucuacuggaccaucgugaagcccggggacauccugcugaucaacagcaccggcaaccucaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcuggcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccucaagagcacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacacgaagaucgaccuguggagcuacaacgccgagcugcucguggcccuggagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggacguacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 62341 - RNA, 1701 nt, Artificial Sequence
  derived and/or modified sequence opt1 from hemagglutinin__InfluenzaA__ABI92951
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacuccugcaucggcagcauccgcaacgggaccuacgaccacgacguguaccgggacgaggcgcucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 62342 - RNA, 1701 nt, Artificial Sequence
  derived and/or modified sequence opt1 from hemagglutinin__InfluenzaA__ABI92962
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcaacaaggccuacagcaacugcuaccccuacgacgugccggacuacgcgucccugcggagccucaucgccuccagcgggacgcuggaguucaacaacgaguccuucaacuggaccggcgucacccagaacgggaccagcuccgccugcaagcgccggagcaacuccagcuucuucucccgccugaacuggcucacgcaccugaaguucaaguaccccgcccugaacgugaccaugcccaacaacgaggaguucgacaagcucuacaucuggggcgugcaccaccccgggaccuacaacgaccagaucagccuguacgcgcaggccuccggccggaucaccgucagcacgaagcgcagccagcagaccgugaucccgaacaucggcucccggccccgcgugcgggacauccccagccgcaucuccaucuacuggaccaucgucaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucgaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 62343 - RNA, 1701 nt, Artificial Sequence; identical to SEQ ID NO: 61641
  derived and/or modified sequence opt1 from hemagglutinin__InfluenzaA__ABI92973

SEQ ID NO: 62344 - RNA, 1701 nt, Artificial Sequence; identical to SEQ ID NO: 61641
  derived and/or modified sequence opt1 from hemagglutinin__InfluenzaA__ABI92984

SEQ ID NO: 62345 - RNA, 1701 nt, Artificial Sequence
  derived and/or modified sequence opt1 from hemagglutinin__InfluenzaA__ABI92995
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgugaucccgaacaucggcagccggccccgcauccgggacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgucaaccgcaucaccuacggcgccugccccaaguacgugaagcagaacacccugaagcucgcgaccgggaugcggaacgugcccgagaagcagacgcgcggcaucuucggggccaucgccggcuucaucgagaacggcugggaggggauggucgacggcugguacggguuccggcaccagaacagcgagggcaucgggcaggccgccgaccugaaguccacccaggcggccaucgaccagaucaacggcaagcugaaccgccucaucggcaagaccaacgagaaguuccaccagaucgagaaggaguucagcgagguggaggggcggauccaggaccuggagaaguacguggaggacaccaagaucgaccugugguccuacaacgccgagcuccuggucgcccuggagaaccagcacacgaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcguggagcugaaguccggcuacaaggacuggauccuguggaucuccuucgccaucagcugcuuccuccugugcgucgcccugcucggguucaucaugugggccugccagaagggcaacauccgcugcaacaucugcaucuga

SEQ ID NO: 62346 - RNA, 1701 nt, Artificial Sequence; identical to SEQ ID NO: 61641
  derived and/or modified sequence opt1 from hemagglutinin__InfluenzaA__ABI93006

SEQ ID NO: 62347 - RNA, 1701 nt, Artificial Sequence; identical to SEQ ID NO: 61641
  derived and/or modified sequence opt1 from hemagglutinin__InfluenzaA__ABI93017

SEQ ID NO: 62348 - RNA, 1698 nt, Artificial Sequence; identical to SEQ ID NO: 62240
  derived and/or modified sequence opt1 from hemagglutinin__InfluenzaA__ABI93028

SEQ ID NO: 62349 - RNA, 1701 nt, Artificial Sequence; identical to SEQ ID NO: 61974
  derived and/or modified sequence opt1 from hemagglutinin__InfluenzaA__ABI93039

SEQ ID NO: 62350 - RNA, 1701 nt, Artificial Sequence
  derived and/or modified sequence opt1 from hemagglutinin__InfluenzaA__ABI93061
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccagcaucggcaagugcaacuccgagugcaucaccccgaacggcagcauccccaacgacaagcccuuccagaacgugaaccgcaucaccuacggggccugcccccgguacgugaagcagaacacgcucaagcuggccaccggcaugcgcaacgucccggagaagcagacccgggggaucuucggcgccaucgccggguucaucgagaacggcugggagggcaugguggacgggugguacggcuuccgccaccagaacuccgaggggaccggccaggccgcggaccugaaguccacgcaggccgccaucaaccagaucaacgggaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcucaagagcggguacaaggacuggauccuguggaucuccuucgccaucagcugcuuccugcugugcgugguccuccugggcuucaucaugugggccugccagaagggcaacauccggugcaacaucugcaucuga

SEQ ID NO: 62351 - RNA, 1701 nt, Artificial Sequence; identical to SEQ ID NO: 61658
  derived and/or modified sequence opt1 from hemagglutinin__InfluenzaA__ABI93072

SEQ ID NO: 62352 - RNA, 1701 nt, Artificial Sequence; identical to SEQ ID NO: 61658
  derived and/or modified sequence opt1 from hemagglutinin__InfluenzaA__ABI93083

SEQ ID NO: 62353 - RNA, 1701 nt, Artificial Sequence; identical to SEQ ID NO: 61658
  derived and/or modified sequence opt1 from hemagglutinin__InfluenzaA__ABI93094

SEQ ID NO: 62354 - RNA, 1701 nt, Artificial Sequence; identical to SEQ ID NO: 61658
  derived and/or modified sequence opt1 from hemagglutinin__InfluenzaA__ABI93105

SEQ ID NO: 62355 - RNA, 1701 nt, Artificial Sequence
  derived and/or modified sequence opt1 from hemagglutinin__InfluenzaA__ABI93116
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccuccugaucaacugcaccggcaaccugaucgccccgcgcggguacuucaagaugcggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgggguguaccgcgacgaggcccugaacaaccgguuccagaucaagggcgucgagcugaaguccggcuacaaggacuggauccucuggaucagcuucgccaucagcugcuuccugcugugcgugguccuccugggguucaucaugugggccugccagaagggcaacauccgcugcaacaucugcaucuga

SEQ ID NO: 62356 - RNA, 1689 nt, Artificial Sequence
  derived and/or modified sequence opt1 from hemagglutinin__InfluenzaA__ABI94581
augaacacccagauccugguguucgcccucgucgccagcauccccaccaacgcggacaagaucugccugggccaccacgccguguccaacgggacgaaggugaacacccugaccgagcgcggcgucgagguggugaacgccaccgagacggucgagcggaccaacgugccgcgcaucugcagcaaggggaagcggaccguggaccucggccagugcgggcugcugggcaccaucacgggcccgccccagugcgaccaguuccucgaguucuccgccgaccugaucaucgagcgccgggaggggagcgacgucugcuaccccggcaaguucgugaacgaggaggcccugcgccagauccuccgggaguccgggggcaucgacaaggagaccaugggguucaccuacagcggcauccgcaccaacggcacgaccuccgcgugccggcgcagcggguccagcuucuacgccgagaugaaguggcugcuguccaacaccgacaacgccgccuucccgcagaugaccaagagcuacaagaacacgcggaaggaccccgcgcucaucaucuggggcauccaccacuccgggagcaccaccgagcagaccaagcuguacggcuccggcaacaagcugaucacgguggggagcuccaacuaccagcagagcuucguccccucccccggcgcccgcccccaggugaacgggcagagcggccggaucgacuuccacuggcucauccugaaccccaacgacaccgugaccuucagcuucaacggggccuucaucgcccccgaccgcgccuccuuccugcggggcaagagcaugggcauccaguccgagguccagguggacgcgaacugcgagggggacugcuaccacagcggcgggaccaucaucuccaaccuccccuuccagaacaucaacagccgcgccgugggcaagugcccgcgguacgucaagcaggagucccugcugcucgccacggggaugaagaacgugcccgagauccccaagcgccggcgccggggccuguucggcgccaucgccggguucaucgagaacggcugggaggggcugaucgacggcugguacggguuccgccaccagaacgcgcagggcgagggcaccgccgccgacuacaagagcacccaguccgccaucgaccagaucaccgggaagcucaaccgccugaucgagaagacgaaccagcaguucgagcugaucgacaacgaguucaccgagguggagaagcagaucggcaacgucaucaacuggacccgggacagcaugaccgaggugugguccuacaacgccgagcuccugguggcgauggagaaccagcacacgaucgaccuggccgacagcgagaugaacaagcucuacgagcgcgucaagcggcagcugcgcgagaacgccgaggaggacgggaccggcugcuucgagaucuuccacaagugcgacgacgacugcauggccuccauccggaacaacaccuacgaccacagcaaguaccgcgaggaggccauccagaaccggauccagaucgaccccgugaagcuguccagcggcuacaaggacgucauccucugguucuccuucggggcgagcugcuucauccugcuggccaucgccaugggccucguguucaucugcgugaagaacgggaacaugcgcugcaccaucugcaucuga

SEQ ID NO: 62357 - RNA, 1701 nt, Artificial Sequence; identical to SEQ ID NO: 61774
  derived and/or modified sequence opt1 from hemagglutinin__InfluenzaA__ABI95228

SEQ ID NO: 62358 - RNA, 1701 nt, Artificial Sequence
  derived and/or modified sequence opt1 from hemagglutinin__InfluenzaA__ABI95239
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggauggugaacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 62359 - RNA, 1698 nt, Artificial Sequence
  derived and/or modified sequence opt1 from hemagglutinin__InfluenzaA__ABI95250
augaaggccaagcugcucgugcugcugugcaccuucaccgccacguacgcggacaccaucugcgucggcuaccacgccaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucuccaaggagagcugguccuacaucguggagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgucaccggggugagcgccuccugcagccacaacggcaaguccagcuucuaccgcaaccuccuguggcugaccgagaagaacgggcucuaccccaaccuguccaagagcuacgugaacaacaaggagaaggagguccuggugcucuggggcgugcaccaccccagcaacaucggggaccagcgggccaucuaccacacggagaacgccuacgucuccguggugagcucccacuacagccgccgguucaccccggagaucgccaagcgccccaagguccggggccaggagggccgcaucaacuacuacuggacccugcuggagcccggggacaccaucaucuucgaggcgaacggcaaccucaucgcccccugguacgccuucgcccugucccggggguucggcagcggcaucaucacguccaacgccccgaugaacgagugcgacgcgaagugccagacgccccagggggccaucaacagcucccugcccuuccagaacgugcaccccgugaccaucggcgagugcccgaaguacguccgcagcgccaagcuccggauggugaccgggcugcgcaacauccccuccauccagagccggggccuguucggggccaucgccggcuucaucgagggcggguggaccggcaugaucgacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcucgagcgccggauggagaaccugaacaagaaggucgacgacggcuuccuggacaucuggaccuacaacgccgagcuccuggugcugcucgagaacgagcgcacccuggacuuccacgacagcaacgugaagaaccuguacgagaaggucaagucccagcucaagaacaacgcgaaggagaucgggaacggcugcuucgaguucuaccacaagugcaacaacgagugcauggagagcgugaagaacgggaccuacgacuaccccaaguacuccgaggagagcaagcugaaccgggagaagaucgacggcgugaagcuggagagcaugggcgucuaccagauccucgccaucuacuccacgguggccagcucccuggugcugcucgucagccugggggccaucuccuucuggaugugcagcaacggcucccugcagugccgcaucugcaucuga

SEQ ID NO: 62360 - RNA, 1698 nt, Artificial Sequence
  derived and/or modified sequence opt1 from hemagglutinin__InfluenzaA__ABI95261
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgugaccggggucagcgccuccugcagccacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacaucggggugcagcgggccaucuaccacacggagaacgccuacgucuccguggugagcucccacuacagccgccgguucaccccggagaucgccaagcgccccaagguccgggaccaggagggccgcaucaacuacuacuggacccugcuggagcccggcgacaccaucaucuucgaggcgaacgggaaccucaucgcccccugguacgccuucgcccugucccggggcuucgagagcgggaucaucacguccaacgccccgaugaacgagugcgacgcgaagugccagacgccccagggcgccaucaacagcucccugcccuuccagaacgugcaccccgugaccaucggcgagugcccgaaguacguccgcagcgccaagcuccggauggugaccgggcugcgcaacauccccuccauccagagccggggccuguucggggccaucgccggcuucaucgagggcggguggaccggcaugaucgacgggugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcucgagcgccggauggagaaccugaacaagaaggucgacgacggcuuccuggacaucuggaccuacaacgccgagcuccuggugcugcucgagaacgagcgcacccuggacuuccacgacagcaacgugaagaaccuguacgagaaggucaagucccagcucaagaacaacgcgaaggagaucgggaacggcugcuucgaguucuaccacaagugcaacaacgagugcauggagagcgugaagaacgggaccuacgacuaccccaaguacuccgaggagagcaagcugaaccgggagaagaucgacggcgugaagcuggagagcaugggggucuaccagauccucgccaucuacuccacgguggccagcucccuggugcugcucgucagccugggcgccaucuccuucuggaugugcagcaacggcucccugcagugccgcaucugcaucuga

SEQ ID NO: 62361 - RNA, 1698 nt, Artificial Sequence; identical to SEQ ID NO: 62240
  derived and/or modified sequence opt1 from hemagglutinin__InfluenzaA__ABI95272

SEQ ID NO: 62362 - RNA, 1698 nt, Artificial Sequence; identical to SEQ ID NO: 62240
  derived and/or modified sequence opt1 from hemagglutinin__InfluenzaA__ABI95283

SEQ ID NO: 62363 - RNA, 1698 nt, Artificial Sequence; identical to SEQ ID NO: 61304
  derived and/or modified sequence opt1 from hemagglutinin__InfluenzaA__ABI95294

SEQ ID NO: 62364 - RNA, 1698 nt, Artificial Sequence
  derived and/or modified sequence opt1 from hemagglutinin__InfluenzaA__ABI96104
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugaucaagagcuacgccaacaacaaggagaaggaggugcucauccuguggggcgugcaccacccgcccaacaucggggaccagcggacccuguaccacacggagaacgccuacgucuccguggugagcagccacuacucccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucagccggggguucggcuccggcaucaucaccagcaacgcccccauggacgagugcgacgccaagugccagacgccccagggggcgaucaacuccagccugcccuuccagaacgugcacccggugaccaucggcgagugccccaaguacguccgcuccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgucaagaaccuguacgagaaggucaagagccagcugaagaacaacgccaaggagaucgggaacggcugcuucgaguucuaccacaagugcaacaacgagugcauggaguccgugaagaacgggacguacgacuaccccaaguacagcgaggaguccaagcucaaccgggagaagaucgacggcgugaagcuggacagcaugggcguguaccagauccuggcgaucuacuccaccguggccagcagccucguccugcuggugucccucggggccaucagcuucuggaugugcuccaacggcagccugcagugccgcaucugcaucuga

SEQ ID NO: 62365 - RNA, 1701 nt, Artificial Sequence; identical to SEQ ID NO: 61658
  derived and/or modified sequence opt1 from hemagglutinin__InfluenzaA__ABJ09107

SEQ ID NO: 62366 - RNA, 1701 nt, Artificial Sequence
  derived and/or modified sequence opt1 from hemagglutinin__InfluenzaA__ABJ09140
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcuccaaggccuacuccaacugcuaccccuacgacgugccggacuacgcgagccuccggucccuggucgccagcuccggcacgcuggaguucaucaacgaggacuucaacuggaccgggguggcccaggacggcaagagcuacuccugcaagcgcgggagcgugaacuccuucuucagccggcucaacuggcugcacaagcuggaguacaaguaccccgcccucaacgucaccaugcccaacaacggcaaguucgacaagcuguacaucuggggcgugcaccaccccuccaccgacagcgaccagacgucccuguacgugcgcgcgagcgggcgggucaccgugagcaccaagcgcucccagcagaccgugaucccgaacaucggcuuccggcccuggguccgcgggcucagcucccggaucagcaucuacuggacgaucgugaagcccggcgacauccugcugaucaacuccaccgggaaccucaucgcgccccgcggcuacuucaagauccggaacggcaagagcuccaucaugcgcagcgacgccccgaucgggaacugcuccagcgagugcaucacccccaacggcuccauccccaacgacaagcccuuccagaacgugaaccggaucaccuacggggccugcccgcgcuacgucaagcagaacacgcugaagcuggccaccggcaugcggaacgugcccgagaagcagacccgcgggaucuucggcgccaucgccggcuucaucgagaacgggugggagggcaugguggacgggugguacggcuuccggcaccagaacagcgaggggaccggccaggccgccgaccucaaguccacgcaggccgcgaucgaccagaucaacggcaagcugaaccgccugaucgagaagaccaacgagaaguuccaccagaucgagaaggaguucagcgaggucgaggggcggauccaggaccucgagaaguacguggaggacaccaagaucgaccugugguccuacaacgccggccugcucguggcccuggagaaccagcacaccaucgaccugacggacagcgagaugaacaagcuguucgagcgcacccgcaagcagcuccgggagaacgccgaggacauggggaacggcugcuucaagaucuaccacaagugcgacaacgccugcaucggguccauccgcaacggcaccuacgaccacgacgucuaccgggacgaggcgcugaacaaccgcuuccagaucaagggcguggagcucaagagcggguacaaggacuggauccuguggaucuccuucgccaucagcugcuuccugcucugcgucgugcugcugggcuucaucaugugggccugccagaaggggaacauccggugcaacaucugcaucuga

SEQ ID NO: 62367 - RNA, 1698 nt, Artificial Sequence
  derived and/or modified sequence opt1 from hemagglutinin__InfluenzaA__ABJ09151
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaagggcaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggcuucgggagcggcaucaucacguccaacgcccccaugggggagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccggggccuguucggggccaucgccggcuucaucgagggcggguggaccgggaugguggacggcugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacggcugcuucgaguucuaccacaagugcaacaacgagugcauggagagcgugaagaacgggaccuacgacuaccccaaguacuccaaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacggcucccugcagugccgcaucugcaucuga

SEQ ID NO: 62368 - RNA, 1701 nt, Artificial Sequence
  derived and/or modified sequence opt1 from hemagglutinin__InfluenzaA__ABJ09162
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccaacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagauccucguggcccuggagaaccagcacacgaucgaccugaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcucaaguccggcuacaaggacuggauccuguggaucagcuucgccaucuccugcuuccugcucugcguggcccugcugggguucaucaugugggccugccagaagggcaacauccggugcaacaucugcaucuga

SEQ ID NO: 62369 - RNA, 1701 nt, Artificial Sequence; identical to SEQ ID NO: 61251
  derived and/or modified sequence opt1 from hemagglutinin__InfluenzaA__ABJ09173

SEQ ID NO: 62370 - RNA, 1698 nt, Artificial Sequence
  derived and/or modified sequence opt1 from hemagglutinin__InfluenzaA__ABJ09184
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggaggcgggggacaccaucaucuucgaggccaacggcaaccugaucgcgccccgguucgccuucgcccucucccgcggguucggcagcggcaucaucacguccaacgccccgauggacgagugcgacgccaagugccagacgccccagggggccaucaacagcucccugcccuuccagaacguccaccccgugaccaucggcgagugcccgaaguacgugcggagcgccaagcugcgcauggccaccgggcuccggaacauccccuccauccagagccgcggccuguucggggcgaucgccggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggcggucgggaaggaguucagcaagcuggagcggcgcauggagaaccucaacaagaagguggacgacggcuuccuggacaucuggaccuacaacgccgagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacggucgccuccagccucgugcugcuggugucccucggggcgaucagcuucuggaugugcuccaacggcagccugcagugccggaucugcaucuga

SEQ ID NO: 62371 - RNA, 1701 nt, Artificial Sequence; identical to SEQ ID NO: 61641
  derived and/or modified sequence opt1 from hemagglutinin__InfluenzaA__ABJ09195

SEQ ID NO: 62372 - RNA, 1701 nt, Artificial Sequence; identical to SEQ ID NO: 61641
  derived and/or modified sequence opt1 from hemagglutinin__InfluenzaA__ABJ09206

SEQ ID NO: 62373 - RNA, 1701 nt, Artificial Sequence; identical to SEQ ID NO: 62221
  derived and/or modified sequence opt1 from hemagglutinin__InfluenzaA__ABJ09217

SEQ ID NO: 62374 - RNA, 1701 nt, Artificial Sequence; identical to SEQ ID NO: 61658
  derived and/or modified sequence opt1 from hemagglutinin__InfluenzaA__ABJ09228

SEQ ID NO: 62375 - RNA, 1701 nt, Artificial Sequence
  derived and/or modified sequence opt1 from hemagglutinin__InfluenzaA__ABJ09239
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgauggaguucaacaacgagagcuucaacuggaccggcguggcccagaacgggaccuccagcgccugcaagcgccgguccaacaagagcuucuucucccgccugaacuggcuccaccagcugaaguacaaguaccccgcgcugaacgugaccaugcccaacaacgagaaguucgacaagcucuacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccugcucaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcugaagcucgccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcugaaccgccucaucgagaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacaccaucgaccucacggacuccgagaugaacaagcuguucgagcgcaccaagaagcagcugcgggagaacgcggaggacauggggaacggcugcuucaagaucuaccacaagugcgacaacgccugcaucgggagcauccgcaacggcaccuacgaccacgacguguaccgcgacgaggcccucaacaaccgguuccagaucaagggggucgagcugaaguccggcuacaaggacuggauccuguggaucagcuucgccaucagcugcuuccuccugugcgugguccugcucggcuucaucaugugggccugccagaaggggaacauccgcugcaacaucugcaucuga

SEQ ID NO: 62376 - RNA, 1701 nt, Artificial Sequence
  derived and/or modified sequence opt1 from hemagglutinin__InfluenzaA__ABJ09250
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucugggggauccaccaccccagcacggacuccgaccagaucagccuguacgcccaggccagcggccgcgucaccguguccaccaagcggagccagcagaccgugaucccgaacaucgggucccgccccuggguccggggcgugagcucccgcaucagcaucuacuggacgaucgugaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgucaaccgcaucaccuacggggccugcccgcgguacgugaagcagaacacgcucaagcuggccaccggcaugcgcaacgugcccgagaagcagacccgggggaucuucggcgccaucgccggguucaucgagaacggcugggagggcauggucgacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacguggaggacaccaagaucgaccucugguccuacaacgccgagcugcuggucgcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgagaccuacgaccacgacguguaccgggacgaggcccugaacaaccgcuuccagaucaaggggguggagcugaaguccggcuacaaggacuggauccucuggaucagcuucgccaucuccugcuuccugcugugcgucgugcuccugggguucaucaugugggccugccagaagggcaacauccggugcaacaucugcaucuga

SEQ ID NO: 62377 - RNA, 1701 nt, Artificial Sequence
  derived and/or modified sequence opt1 from hemagglutinin__InfluenzaA__ABJ09261
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggaagaucugcgacagcccccaccagauccuggacggcgagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaacaacgagagcuucaacuggaccgggguggcccagaacggcaccuccagcgccugcaagcgccgguccaucaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaccagccuguacgcccaggccagcgggcgggugaccguguccaccaagcgcagccagcagacggucaucccgaacaucgggucccggcccugggugcgcggcgugagcucccggaucagcaucuacuggaccaucgucaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccucaagcuggccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcucaaccgccugaucgagaagaccaacgagaaguaccaccagaucgagaaggaguucagcgagguggagggccggauccaggaccuggagaaguacgucgaggacaccaagaucgaccucugguccuacaacgccgagcugcugguggcccucgagaaccagcacacgaucgaccugaccgacagcgagaugaacaagcuguucgagcgcacccggaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 62378 - RNA, 1701 nt, Artificial Sequence
  derived and/or modified sequence opt1 from hemagglutinin__InfluenzaA__ABJ09272
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcaacagcccccaccagauccuggacggcgagaacugcacccugaucgacgcccuccugggggacccccacugcgacggcuuccagaacaaggagugggaccuguucguggagcggcgcaaggccuacagcaacugcuaccccuacgacgugccggacuacgcgucccuccggagccuggucgccuccagcggcacgcuggaguucaacaacgaguccuucaacuggaccgggguggcccagaacggcaccagcuccgccugcaagcgccggagcaucaaguccuucuucagccgccucaacuggcugcaccagcugaaguacaaguaccccgcgcucaacgugaccaugcccaacaacgagaaguucgacaagcuguacaucuggggcguccaccaccccuccacggacagcgaccagaucucccuguacgcccaggccagcgggcgggugaccgugagcaccaagcgcucccagcagaccgucaucccgaacaucgggagccggcccugggugcgcggcguguccagccggaucuccaucuacuggacgaucgucaagcccggcgacauccuccugaucaacagcaccgggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacuccgaggggaccggccaggccgcggaccucaagagcacgcaggccgccaucaaccagaucaacgggaagcugaaccgccugaucgagaagaccaacgagaaguuccaccagaucgagaaggaguucuccgagguggagggccggauccaggaccuggagaaggacgucgaggacaccaagaucgaccucuggagcuacaacgccgagcugcugguggcccucgagaaccagcacaccaucgaccugacggacuccgagaugaacaagcuguucgagcgcaccaagaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgguuccagaucaagggcgucgagcugaaguccggguacaaggacuggauccucuggaucagcuucgccaucagcugcuuccugcugugcgugguccuccugggcuucaucaugugggccugccagaagggcaacauccgcugcaacaucugcaucuga

SEQ ID NO: 62379 - RNA, 1701 nt, Artificial Sequence; identical to SEQ ID NO: 61080
  derived and/or modified sequence opt1 from hemagglutinin__InfluenzaA__ABJ09294

SEQ ID NO: 62380 - RNA, 1701 nt, Artificial Sequence
  derived and/or modified sequence opt1 from hemagglutinin__InfluenzaA__ABJ09305
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgagaccuacgaccacgacguguaccgggacgaggcccugaacaaccgcuuccagaucaagggggucgagcugaaguccggcuacaaggacuggauccucuggaucagcuucgccaucuccugcuuccugcugugcgugguccuccugggguucaucaugugggccugccagaagggcaacauccggugcaacaucugcaucuga

SEQ ID NO: 62381 - RNA, 1701 nt, Artificial Sequence
  derived and/or modified sequence opt1 from hemagglutinin__InfluenzaA__ABJ09316
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaacaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccacugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccagcaucggcaagugcaacuccgagugcaucacccccaacggcagcaucccgaacgacaagcccuuccagaacgugaaccgcaucaccuacggggccugcccccgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacuccgaggggaccggccaggccgcggaccugaaguccacgcaggccgccaucaaccagaucaacgggaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcucaagagcggguacaaggacuggauccuguggaucuccuucgccaucagcugcuuccugcugugcgugguccuccugggcuucaucaugugggccugccagaagggcaacauccggugcaacaucugcaucuga

SEQ ID NO: 62382 - RNA, 1701 nt, Artificial Sequence; identical to SEQ ID NO: 61658
  derived and/or modified sequence opt1 from hemagglutinin__InfluenzaA__ABJ09338

SEQ ID NO: 62383 - RNA, 1701 nt, Artificial Sequence
  derived and/or modified sequence opt1 from hemagglutinin__InfluenzaA__ABJ09349
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucauccagagcuccagcaccgggggcaucugcgacagcccccaccagauccuggacggggagaacugcacccugaucgacgcccuccugggcgacccccacugcgacggcuuccagaacaaggagugggaccuguucgucgagcgcagcaaggccuacuccaacugcuaccccuacgacgugccggacuacgcgagccuccggucccugguggccagcuccgggacgcuggaguucaacaacgagagcuucaacuggaccggcgucgcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcgugcaccaccccagcacggacuccgaccagaucagccuguacgcccaggccccggggcgggucaccgugagcaccaagcgcucccagcagaccgugauccccaacaucggcagccggcccuggguccgcggcguguccagccggaucuccaucuacuggacgaucgugaagcccggggacauccuccugaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgucaaccggaucaccuacggcgcgugcccgcgcuacgugaagcagaacacgcucaagcuggccaccgggaugcggaacgugcccgagaagcagacccgcggcaucuucggggccaucgccggcuucaucgagaacggcugggaggggauggucgacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaaggggguggagcugaaguccggcuacaaggacuggauccucuggaucagcuucgccaucagcugcuuccugcugugcgucgugcuccugggcuucaucaugugggccugccagaaggggaacauccgcugcaacaucugcaucuga

SEQ ID NO: 62384 - RNA, 1701 nt, Artificial Sequence; identical to SEQ ID NO: 61658
  derived and/or modified sequence opt1 from hemagglutinin__InfluenzaA__ABJ09360

SEQ ID NO: 62385 - RNA, 1701 nt, Artificial Sequence
  derived and/or modified sequence opt1 from hemagglutinin__InfluenzaA__ABJ09371
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgugaucccgaacaucggcagccggcugcgcgugcgggacauccccucccgcaucagcaucuacuggaccaucgucaagcccggggacauccuccugaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgugaaccgcaucaccuacggcgccugcccgcgguacgugaagcagaacacccucaagcuggccaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcucaaccggcugaucggcaagaccaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcugaaguccggcuacaaggacuggauccucuggaucuccuucgccaucagcugcuuccugcugugcguggcccuccugggguucaucaugugggccugccagaagggcaacauccggugcaacaucugcaucuga

SEQ ID NO: 62386 - RNA, 1701 nt, Artificial Sequence; identical to SEQ ID NO: 61641
  derived and/or modified sequence opt1 from hemagglutinin__InfluenzaA__ABJ09382

SEQ ID NO: 62387 - RNA, 1701 nt, Artificial Sequence
  derived and/or modified sequence opt1 from hemagglutinin__InfluenzaA__ABJ16587
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccagauccucgacggcgagaacugcacccugaucgacgcccugcucggggacccccacugcgacggcuuccagaacaaggagugggaccuguucguggagcgguccaaggccuacagcaacugcuaccccuacgacgugccggacuacgcgucccugcgcagccucgucgccuccagcggcacgcuggaguucaacaacgaguccuucaacuggaccgggguggcccagaacggcaccagcuccgccugcaagcggcgcagcaucaaguccuucuucagccggcugaacuggcuccaccagcugaaguaccgcuaccccgcgcugaacgugaccaugcccaacaacgacaaguucgacaagcucuacaucuggggcguccaccaccccuccacggacagcgaccagaccagccuguacgcccaggccuccgggcgggugaccgugagcaccaagcgcucccagcagacggucaucccgaacaucgggagccggcccugggugcgcggcguguccagccggaucuccaucuacuggaccaucgucaagcccggcgacauccugcucaucaacagcaccgggaaccugaucgcgccccgcggcuacuucaagauccgguccggcaagagcuccaucaugcgcagcgacgccccgaucgggaagugcaacuccgagugcaucacccccaacggcagcauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugauggacgggugguacggcuuccggcaccagaacuccgaggggacgggccaggccgcggaccucaagagcacccaggccgccaucaaccagaucaacgggaagcugaaccgccugaucgagaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacacgaucgaccucaccgacuccgagaugaacaagcuguucgagcgcacccgcaagcagcugcgggagaacgcggaggacaugggcaacgggugcuucaagaucuaccacaagugcgacaacgccugcaucggcagcauccgcaacgggaccuacgaccacgacguguaccgggacgaggcccucaacaaccgcuuccagaucaagggcguggagcucaagagcggguacaaggacuggauccuguggaucuccuucgccaucagcugcuuccugcugugcgucgugcugcucggcuucaucaugugggccugccagaagggcaacauccggugcaacaucugcaucuga

SEQ ID NO: 62388 - RNA, 1701 nt, Artificial Sequence
  derived and/or modified sequence opt1 from hemagglutinin__InfluenzaA__ABJ16598
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcaacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgcgagccuccgcucccuggucgccagcuccggcacgcuggaguucaacaacgagagcuucaacuggaccgggguggcccagaacggcaccuccagcgccugcaagcggcgcuccaucaagagcuucuucucccggcucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgcgugaccguguccaccaagcggagccagcagaccgucaucccgaacaucgggucccgccccugggugcggggcgugagcucccgcaucagcaucuacuggacgaucgucaagcccggcgacauccuccugaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccgcaacgggaccuacgaccacgacguguaccgggacgaggcccugaacaaccgcuuccagaucaagggcgucgagcugaaguccggguacaaggacuggauccucuggaucagcuucgccaucuccugcuuccugcugugcgugguccuccugggcuucaucaugugggccugccagaagggcaacauccggugcaacaucugcaucuga

SEQ ID NO: 62389 - RNA, 1701 nt, Artificial Sequence
  derived and/or modified sequence opt1 from hemagglutinin__InfluenzaA__ABJ16620
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcaacagcccccaccagauccuggacggcgagaacugcacccugaucgacgcccuccugggggacccccacugcgacggcuuccagaacaaggagugggaccuguucguggagcggaacaaggccuacagcaacugcuaccccuacgacgugccggacuacgcgucccuccgcagccuggucgccuccagcggcacgcuggaguucaacaacgaguccuucaacuggaccgggguggcccagaacggcaccagcuccgccugcaagcggcgcagcaucaaguccuucuucagccggcucaacuggcugcaccagcugaaguacaaguaccccgcgcucaacgugaccaugcccaacaacgagaaguucgacaagcuguacaucuggggcguccaccaccccuccacggacagcgaccagaucucccuguacgcccaggccagcgggcgcgugaccgugagcaccaagcggucccagcagaccgucaucccgaacaucgggagccgccccugggugcggggcguguccagccgcaucuccaucuacuggacgaucgucaagcccggcgacauccuccugaucaacagcaccgggaaccugaucgcgccccggggcuacuucaagauccgcuccgggaaguccuccaucaugcggagcgacgccccgaucggcaagugcaacuccgagugcaucacccccaacggcagcauccccaacgacaagcccuuccagaacgugaaccgcaucaccuacggggccugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacuccgaggggaccggccaggccgcggaccucaagagcacgcaggccgccaucaaccagaucaacgggaagcugaaccggcugaucgagaagaccaacaagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucggcagcauccgcaacgggaccuacgaccacgacguguaccgggacgaggcccugaacaaccgcuuccagaucaagggcgucgagcugaaguccggguacaaggacuggauccucuggaucagcuucgccaucagcugcuuccugcugugcgugguccuccugggcuucaucaugugggccugccagaagggcaacauccggugcaacaucugcaucuga

SEQ ID NO: 62390 - RNA, 1701 nt, Artificial Sequence
  derived and/or modified sequence opt1 from hemagglutinin__InfluenzaA__ABJ16631
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 62391 - RNA, 1698 nt, Artificial Sequence
  derived and/or modified sequence opt1 from hemagglutinin__InfluenzaA__ABJ16664
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggccacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagcggaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 62392 - RNA, 1698 nt, Artificial Sequence; identical to SEQ ID NO: 62212
  derived and/or modified sequence opt1 from hemagglutinin__InfluenzaA__ABJ16675

SEQ ID NO: 62393 - RNA, 1698 nt, Artificial Sequence
  derived and/or modified sequence opt1 from hemagglutinin__InfluenzaA__ABJ16686
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacggucgccuccagccucgugcugcuggugucccucggggccaucagcuucuggaugugcuccaacggcagccugcagugccggaucugcaucuga

SEQ ID NO: 62394 - RNA, 1701 nt, Artificial Sequence
  derived and/or modified sequence opt1 from hemagglutinin__InfluenzaA__ABJ16697
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccuccugaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgccgugcuccugggcuucaucaugugggcgugccagaaggggaacauccgcugcaacaucugcaucuga

SEQ ID NO: 62395 - RNA, 1701 nt, Artificial Sequence
  derived and/or modified sequence opt1 from hemagglutinin__InfluenzaA__ABJ16730
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagagcugguccuacaucgccgagacccccaaccccaagaacggcacgugcuaccccggcuacuucgccgacuacgaggagcuccgggagcagcugagcuccgugagcuccuucgagcgcuucgagaucuucccgaaggacagcuccuggcccaaccacaccgucaccaagggggugaccgccagcugcucccacaacggcaagagcuccuucuacaagaaccugcucuggcugacggagaagaacgggcuguaccccaaccucagcaaguccuacgugaacaagaagggcaaggagguccuggugcuguggggcgugcaccaccccagcaacaugggggaccagcgggccaucuaccacaaggagaacgcguacgucagcgugcucuccagccacuacucccgccgguucaccccggagaucgcccgccggcccaaggugcgcgaccaggagggccggaucaacuacuacuggacccugcuggagcccggggacaccaucaucuucgaggccaacggcaaccucaucgcccccugguacgccuucgcgcugagccgcggguucggcuccggcaucaucaucagcaacgccuccaugggggagugcgacgccaagugccagacgccgcagggcgccaucaacagcucccugcccuuccagaacguccaccccgugaccaucggggagugccccaaguacgugcggagcaccaagcuccgcauggucaccggccugcggaacgugccguccauccagagccgcgggcuguucggcgccaucgcgggcuucaucgagggcggguggacggggaugaucgacggcugguacggguaccaccaccagaacgagcagggcuccggcuacgccgccgaccagaaguccacccagaacgccaucaacgggaucaccaacaaggugaacagcaucaucgagaagaugaacacccaguucacggccgucggcaaggaguucaacaagcucgagcggcgcauggagaaccugaacaagaagguggacgacggguuccuggacaucuggaccuacaacgcggagcuccuggugcugcucgagaacgagcggacccuggacuuccacgacagcaacgucaagaaccuguacgagaaggugaagaaccagcucaagaacaacgccaaggagaucggcaacgggugcuucgaguucuaccacaagugcaacaacgagugcauggaguccgucaagaacggcaccuacgacuaccccaaguacagcaaggaguccaagcugaaccgcgagaagaucgacggcgugaagcuggagagcauggggguguaccagauccucgccaucuacagcacggucgccuccagccuggugcugcucgugucccugggcgccaucagcuucuggaugugcuccaacgggagccugcagugccggaucugcaucuga

SEQ ID NO: 62396 - RNA, 1701 nt, Artificial Sequence
  derived and/or modified sequence opt1 from hemagglutinin__InfluenzaA__ABJ16741
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagggcuucuucagccgccucaacuggcugcaccagcugaaguacaaguaccccgcgcucaacgugaccaugcccaacaacgagaaguucgacaagcuguacaucuggggcguccaccaccccuccacggacagcgaccagaucucccuguacgcccaggccccggggcgggugaccgugagcaccaagcgcagccagcagaccgucauccccaacaucggcucccggcccugggugcgcggggugagcuccaucaucagcaucuacuggacgaucgucaagcccggcgacauccuccugaucaacugcaccgggaaccugaucgccccgcggggcuacuucaagauccgcuccggcaagagcuccaucaugcggagcgacgccuccaucgggaagugcaacagcgagugcaucacccccaacggcuccauccccaacgacaagcccuuccagaacgugaaccgcaucaccuacggggcgugcccgcgguacgugaagcagaacacgcucaagcuggccaccggcaugcgcaacguccccgagaagcagacccgggggaucuucggcgccaucgccggcuucaucgagaacgggugggagggcaugguggacgggugguacggcuuccgccaccagaacagcgaggggaccggccaggccgcggaccugaaguccacgcaggccgccaucaaccagaucaacggcaagcucaaccggcugaucgggaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacauggggaacggcugcuucaagaucuaccacaagugcgacaacgccugcaucggguccauccggaacggcaccuacgaccacgacguguaccgcgacgaggcccugaacaaccgcuuccagaucaagggcgucgagcugaaguccggguacaaggacuggauccucuggaucuccuucgccaucagcugcuuccugcugugcgugguccuccugggcuucaucaugugggccugccagaaggggaacauccggugcaacaucugcaucuga

SEQ ID NO: 62397 - RNA, 1701 nt, Artificial Sequence
  derived and/or modified sequence opt1 from hemagglutinin__InfluenzaA__ABJ16752
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagcgggaucuccaucuacuggacgaucgucaagcccggcgacauccuccugaucaacugcaccgggaaccugaucgccccgcggggcuacuucaagauccgcagcggcaaguccagcaucaugcgguccgacgccagcaucgggaagugcaacuccgagugcaucacccccaacggcagcauccccaacgacaagcccuuccagaacgugaaccgcaucaccuacggggcgugcccgcgguacgugaagcagaacacgcucaagcuggccaccggcaugcgcaacguccccgagaagcagacccgggggaucuucggcgccaucgccggcuucaucgagaacgggugggagggcaugguggacgggugguacggcuuccgccaccagaacuccgaggggaccggccaggccgcggaccugaaguccacgcaggccgccaucaaccagaucaacggcaagcucaaccggcugaucgagaagaccaacgagaaguuccaccagaucgagaaggaguucuccgagguggaggggcgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgcuuccagaucaagggcgucgagcugaaguccggcuacaaggacuggauccucuggaucagcuucgccaucagcugcuuccugcugugcgugguccuccugggguucaucaugugggccugccagaagggcaacauccggugcaacaucugcaucuga

SEQ ID NO: 62398 - RNA, 1701 nt, Artificial Sequence
  derived and/or modified sequence opt1 from hemagglutinin__InfluenzaA__ABJ16763
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcacugggugcgcggcguguccagccggaucuccaucuacuggacgaucgucaagcccggggacauccuccugaucaacugcaccggcaaccugaucgcgccccgcggguacuucaagauccggagcggcaaguccagcaucaugcgcuccgacgccagcaucggcaagugcaacuccgagugcaucaccccgaacgggagcauccccaacgacaagcccuuccagaacgugaaccggaucaccuacggcgccugcccccgcuacgugaagcagaacacgcucaagcuggccaccgggaugcggaacgucccggagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 62399 - RNA, 1701 nt, Artificial Sequence
  derived and/or modified sequence opt1 from hemagglutinin__InfluenzaA__ABJ16774
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcucccccaccggccgcaucugcgacagcccccaccagauccuggacggggagaacugcacccugaucgacgcccuccugggcgacccccacugcgacggguuccagaacaaggagugggaccuguucguggagcgguccacggccuacagcaacugcuacccguacgacguccccgacuacgcgucccuccgcagccugguggccuccagcggcacccuggaguucaacaacgaguccuucaacuggaccggcguggcccagaacgggaccagcuccgccugcaagcggcgcagcaucaaguccuucuucagccggcucaacuggcugcaccagcugaaguacaaguaccccgcgcucaacgucacgaugcccaacaacgagaaguucgacaagcuguacaucuggggcgugcaccacccguccaccgacagcgaccagaucucccuguacgcccaggccagcgggcgcgugaccgucagcaccaagcggucccagcagacggugauccccaacaucggcagcgggcccugggugcgcggcgucuccagccggaucuccaucuacuggaccaucgugaagcccggcgacauccuccugaucaacagcaccgggaaccugaucgccccgcgcggcuacuucaagauccggaacgggaaguccagcaucaugcgcuccaacacccccaucggcaagugcaacagcgagugcaucacgcccaacggcuccauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggguucaucgagaacggcugggagggcaugguggacgggugguacggcuuccggcaccagaacagcgaggggaccggccaggccgccgaccugaaguccacccaggcggccaucaaccagaucaacgggaagcucaaccgccugaucgagaagaccaacgagaaguuccaccagaucgagaaggaguucagcgaggucgagggccggauccaggaccuggagaaguacguggaggacacgaagaucgaccucugguccuacaacgccgagcugcugguggcccucgagaaccagcacaccaucgaccugaccgacagcgagaugaacaagcuguucgagcgcacccggaagcagcuccgcgagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcucaagagcggguacaaggacuggauccuguggaucuccuucgccaucagcugcuuccugcugugcgucgugcuccugggcuucaucaugugggccugccagaagggcaacauccggugcaacaucugcaucuga

SEQ ID NO: 62400 - RNA, 1701 nt, Artificial Sequence
  derived and/or modified sequence opt1 from hemagglutinin__InfluenzaA__ABJ16785
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccuacgccugcaagcgccggagcaacaaguccuucuucagccgccucaacuggcugcaccagcugaaguacaaguaccccgcgcucaacgugaccaugcccaacaacgagaaguucgacaagcuguacaucuggggcguccaccaccccuccacggacagcgaccagaucucccuguacgcccaggccccggggcgggugaccgugagcaccaagcgcagccagcagaccgucauccccaacaucggcucccggcccugggugcgcggcgugagcucccggaucagcaucuacuggacgaucgucaagcccggggacauccuccugaucaacugcaccggcaaccugaucgccccgcgcggguacuucaagauccgguccggcaagagcuccaucaugcgcagcgacgccuccaucggcaagugcaacagcgagugcaucacccccaacggguccauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacagcgagggcaccgggcaggccgcggaccugaaguccacgcaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucuccuucgccaucagcugcuuccugcugugcgugguccuccugggcuucaucaugugggccugccagaaggggaacauccgcugcaacaucugcaucuga

SEQ ID NO: 62401 - RNA, 1701 nt, Artificial Sequence; identical to SEQ ID NO: 61918
  derived and/or modified sequence opt1 from hemagglutinin__InfluenzaA__ABJ53438

SEQ ID NO: 62402 - RNA, 1698 nt, Artificial Sequence; identical to SEQ ID NO: 61750
  derived and/or modified sequence opt1 from hemagglutinin__InfluenzaA__ABJ53449

SEQ ID NO: 62403 - RNA, 1701 nt, Artificial Sequence
  derived and/or modified sequence opt1 from hemagglutinin__InfluenzaA__ABJ53471
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuaccccuacgacgugccggacuacgcgagccugcggucccuggucgccagcuccgggacgcucgaguucaacaacgagagcuucaacuggaccggcgugacccagaacgggaccuccagcgccugcaagcgcggcuccaacaacagcuucuucucccggcugaacuggcugacgcaccucaaguucaaguaccccgcccugaacgugaccaugcccaacaacgagaaguucgacaagcuguacaucuggggcguccaccaccccgggaccgacaacgaccagaucuuccucuacgcgcaggccagcggccgcaucaccguguccacgaagcggagccagcagaccgugaucccgaacaucgggagccgcccccggguccgcaacauccccucccggaucagcaucuacuggaccaucgugaagcccggcgacauccugcugaucaacuccaccgggaaccucaucgccccgcgcggcuacuucaagauccggagcggcaaguccagcaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccucaaguccacccaggcggccaucaaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaagggcguggagcucaagagcggguacaaggacuggauccuguggaucuccuucgccaucagcugcuuccugcucugcguggcccugcugggcuucaucaugugggccugccagaaggggaacauccgcugcaacaucugcaucuga

SEQ ID NO: 62404 - RNA, 1701 nt, Artificial Sequence
  derived and/or modified sequence opt1 from hemagglutinin__InfluenzaA__ABJ53482
augaagaccaucaucgcccugagcuacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacgcuggaguucaacaacgagagcuucaacuggaccggggugacccagaacggcaccuccagcgccugcaagcggcgcuccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucaaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 62405 - RNA, 1698 nt, Artificial Sequence; identical to SEQ ID NO: 62240
  derived and/or modified sequence opt1 from hemagglutinin__InfluenzaA__ABJ53493

SEQ ID NO: 62406 - RNA, 1698 nt, Artificial Sequence
  derived and/or modified sequence opt1 from hemagglutinin__InfluenzaA__ABJ53504
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgugaccggggucagcgccuccugcagccacaacggcaaguccagcuucuaccgcaaccuccuguggcugaccgagaagaacgggcucuaccccaaccuguccaagagcuacgugaacaacaaggagaaggaggugcugguccucuggggcgugcaccaccccagcaacaucggggugcagcgggccaucuaccacacggagaacgccuacgucuccguggugagcucccacuacagccgccgguucaccccggagaucgccaagcgccccaagguccgggaccaggagggccgcaucaacuacuacuggacccugcuggagcccggcgacaccaucaucuucgaggcgaacgggaaccucaucgcccccugguacgccuucgcccugucccggggcuucgagagcgggaucaucacguccaacgccccgaugaacgagugcgacgcgaagugccagacgccccugggcgccaucaacagcucccuccccuuccagaacgugcaccccgugaccaucggcgagugcccgaaguacguccgcagcgccaagcugcggauggugaccgggcugcgcaacauccccuccauccagagccggggccucuucggggccaucgccggcuucaucgagggcggguggaccggcaugaucgacgggugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccugaacaagaaggucgacgacggcuuccucgacaucuggaccuacaacgccgagcugcuggugcuccuggagaacgagcgcacccuggacuuccacgacagcaacgugaagaaccucuacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcugaaccgggagaagaucgacggcgugaagcucgagagcaugggggucuaccagauccuggccaucuacuccacgguggccagcucccuggugcuccuggucagccugggcgccaucuccuucuggaugugcagcaacggcucccuccagugccgcaucugcaucuga

SEQ ID NO: 62407 - RNA, 1701 nt, Artificial Sequence; identical to SEQ ID NO: 62395
  derived and/or modified sequence opt1 from hemagglutinin__InfluenzaA__ABJ53515

SEQ ID NO: 62408 - RNA, 1701 nt, Artificial Sequence
  derived and/or modified sequence opt1 from hemagglutinin__InfluenzaA__ABK39962
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaagacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcaucgugcuccugggcuucaucaugugggccugccagaaggggaacauccggugcaacaucugcaucuga

SEQ ID NO: 62409 - RNA, 1701 nt, Artificial Sequence; identical to SEQ ID NO: 61638
  derived and/or modified sequence opt1 from hemagglutinin__InfluenzaA__ABK39973

SEQ ID NO: 62410 - RNA, 1701 nt, Artificial Sequence
  derived and/or modified sequence opt1 from hemagglutinin__InfluenzaA__ABK39984
augaagaccaucaucgcccugagcuacauccucugccugguguucgcccagaagcugcccggcaacgacaacucccgcgcgacccucugccuggggcaccacgccgucccgaacggcacgaucgugaagaccaucaccaacgaccagaucgaggugaccaacgccacggagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcggagcaaggccuacuccaacugcuaccccuacgacgugccggacuacgcgagccugcgcucccucgucgccagcuccgggacccuggaguucaacaacgagagcuucaacuggacgggcgugacccagaacgggaccuccagcgccugcaagcggcgcuccaacaacagcuucuucucccggcugaacuggcucacccaccugaaguucaaguaccccgcccugaacgugacgaugcccaacaacgagaaguucgacaagcucuacaucuggggcguccaccaccccgggaccgacaacgaccagaucuuccuguacgcgcaggccagcggccgcaucaccguguccaccaagcggagccagcagacggugaucccgaacaucggcagccgcccccggguccgcaacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacccccaacggguccauccccaacgacaagccguuccagaacgugaaccggaucacguacggcgccugcccccgcuacgucaagcagaacacccugaagcucgcgaccgggaugcggaacgugcccgagaagcagacccgcggcaucuucggggccaucgccggcuucaucgagaacggcugggaggggaugguggacggcugguacggguuccggcaccagaacagcgagggcaucgggcaggccgccgaccugaaguccacgcaggcggccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacaccaucgaccucacggacagcgagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 62411 - RNA, 1698 nt, Artificial Sequence
  derived and/or modified sequence opt1 from hemagglutinin__InfluenzaA__ABK39995
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguacuccuucgagcgguucgagaucuucccgaaggagagcuccuggcccaaccacacggugaccggggucagcgccuccugcagccacaacggcaaguccagcuucuaccgcaaccugcuguggcucaccgggaagaacggccuguaccccaaccuguccaagagcuacgccaacaacaaggagaaggaggugcucauccuguggggcgugcaccacccgcccaacaucgggaaccagcggacccuguaccacacggagaacgccuacgucuccguggugagcagccacuacucccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucagccggggguucggcuccggcaucaucaccagcaacgcccccauggacgagugcgacgccaagugccagacgccccagggggcgaucaacuccagccugcccuuccagaacgugcacccggugaccaucggcgagugccccaaguacguccgcuccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgucaagaaccuguacgagaaggucaagagccagcugaagaacaacgccaaggagaucgggaacggcugcuucgaguucuaccacaagugcaacaacgagugcauggaguccgugaagaacgggacguacgacuaccccaaguacagcgaggaguccaagcucaaccgggagaagaucgacggcgugaagcuggacagcaugggcguguaccagauccuggcgaucuacuccaccguggccagcagccucguccugcuggugucccucggggccaucagcuucuggaugugcuccaacggcagccugcagugccgcaucugcaucuga

SEQ ID NO: 62412 - RNA, 1701 nt, Artificial Sequence
  derived and/or modified sequence opt1 from hemagglutinin__InfluenzaA__ABK40017
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacaagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 62413 - RNA, 1701 nt, Artificial Sequence
  derived and/or modified sequence opt1 from hemagglutinin__InfluenzaA__ABK40028
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagagcugguccuacaucgccgagacccccaaccccaagaacggcacgugcuaccccggcuacuucgccgacuacgaggagcuccgggagcagcugagcuccgugagcuccuucgagcgcuucgagaucuucccgaaggacagcuccuggcccaaccacaccgucaccaagggggugaccgccagcugcucccacaacggcaagagcuccuucuacaagaaccugcucuggcugacggagaagaacgggcuguaccccaaccucagcaaguccuacgugaacaagaagggcaaggagguccuggugcuguggggcgugcaccaccccagcaacaugggggaccagcgggccaucuaccacaaggagaacgcguacgucaccgugcucagcucccacuacagccgccgguucaccccggagaucgcccgccggcccaaggugcgcgaccaggagggccggaucaacuacuacuggacccugcuggagcccggggacacgaucaucuucgaggccaacggcaaccucaucgcccccugguacgccuucgcgcugucccgcggguucggcagcggcaucaucaucuccaacgccagcaugggggagugcgacgccaagugccagaccccgcagggcgccaucaacuccagccugcccuuccagaacguccaccccgugaccaucggggagugccccaaguacgugcgguccaccaagcuccgcauggucacgggccugcggaacgugccgagcauccagucccgcgggcuguucggcgccaucgcgggcuucaucgagggcggguggaccgggaugaucgacggcugguacggguaccaccaccagaacgagcagggcagcggcuacgccgccgaccagaaguccacccagaacgccaucaacgggaucaccaacaaggugaacagcaucaucgagaagaugaacacgcaguucaccgccgucggcaaggaguucaacaagcucgagcggcgcauggagaaccugaacaagaagguggacgacggguuccuggacaucuggaccuacaacgcggagcuccuggugcugcucgagaacgagcggacccuggacuuccacgacuccaacgucaagaaccuguacgagaaggugaagaaccagcucaagaacaacgccaaggagaucggcaacgggugcuucgaguucuaccacaagugcaacaacgagugcauggagagcgucaagaacggcacguacgacuaccccaaguacuccaaggagagcaagcugaaccgcgagaagaucgacggcgugaagcuggaguccauggggguguaccagauccucgccaucuacagcaccgucgccagcucccuggugcugcucgugagccugggcgccaucuccuucuggaugugcagcaacgggucccugcagugccggaucugcaucuga

SEQ ID NO: 62414 - RNA, 1701 nt, Artificial Sequence; identical to SEQ ID NO: 62395
  derived and/or modified sequence opt1 from hemagglutinin__InfluenzaA__ABK40039

SEQ ID NO: 62415 - RNA, 1701 nt, Artificial Sequence; identical to SEQ ID NO: 62395
  derived and/or modified sequence opt1 from hemagglutinin__InfluenzaA__ABK40050

SEQ ID NO: 62416 - RNA, 1701 nt, Artificial Sequence; identical to SEQ ID NO: 61658
  derived and/or modified sequence opt1 from hemagglutinin__InfluenzaA__ABK40061

SEQ ID NO: 62417 - RNA, 1701 nt, Artificial Sequence; identical to SEQ ID NO: 61658
  derived and/or modified sequence opt1 from hemagglutinin__InfluenzaA__ABK40075

SEQ ID NO: 62418 - RNA, 1701 nt, Artificial Sequence; identical to SEQ ID NO: 61929
  derived and/or modified sequence opt1 from hemagglutinin__InfluenzaA__ABK40510

SEQ ID NO: 62419 - RNA, 1701 nt, Artificial Sequence; identical to SEQ ID NO: 61929
  derived and/or modified sequence opt1 from hemagglutinin__InfluenzaA__ABK40534

SEQ ID NO: 62420 - RNA, 1701 nt, Artificial Sequence
  derived and/or modified sequence opt1 from hemagglutinin__InfluenzaA__ABK40546
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaacaagagcugguccuacaucgccgagacccccaacagcgagaacgggaccugcuaccccggcuacuucgccgacuacgaggagcugcgcgagcagcuguccagcguguccagcuucgagcgguucgagaucuuccccaaggaguccagcuggccgaagcacaacgucaccaagggggugacggccuccugcagccacaagggcaaguccagcuucuaccgcaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccggaaggagaacgccuacgucagcgugguguccagccacuacaaccgccgguucacccccgagaucgcgaagcgcccgaagguccggaaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgagcauggacgagugcgacgccaagugccagacgccccagggcgccaucaacuccagccugccguuccagaacgugcaccccgugaccaucggcgagugccccaaguacguccgcuccaccaagcugcggauggugaccgggcuccgcaacauccccagcauccagucccggggccuguucggggccaucgccggcuucaucgagggcggcuggaccggcaugaucgacgggugguacggcuaccaccaccagaacgagcaggggagcggcuacgcggccgaccagaaguccacgcagaacgccaucaacgggaucaccaacaaggugaacagcaucaucgagaagaugaacacccaguucaccgccgucggcaaggaguucaacaagcuggagaagcgcauggagaaccucaacaagaagguggacgacggcuuccuggacaucuggacguacaacgccgagcugcucgugcugcuggagaacgagcggacccucgacuuccacgacuccaacgucaagaaccuguacgagaaggucaagagccagcugaagaacaacgcgaaggagaucgggaacggcugcuucgaguucuaccacaagugcaacaacgagugcauggaguccgugaagaacgggaccuacgacuacccgaaguacagcgaggagagcaagcucaaccgcgagaagaucgacggcgugaagcuggaguccauggggguguaccagauccuggccaucuacagcaccgucgccuccagccucgugcugcuggugucccucggcgccaucagcuucuggaugugcuccaacggcagccugcagugccggaucugcaucuga

SEQ ID NO: 62421 - RNA, 1701 nt, Artificial Sequence; identical to SEQ ID NO: 61929
  derived and/or modified sequence opt1 from hemagglutinin__InfluenzaA__ABK40557

SEQ ID NO: 62422 - RNA, 1701 nt, Artificial Sequence; identical to SEQ ID NO: 61929
  derived and/or modified sequence opt1 from hemagglutinin__InfluenzaA__ABK40568

SEQ ID NO: 62423 - RNA, 1701 nt, Artificial Sequence; identical to SEQ ID NO: 61929
  derived and/or modified sequence opt1 from hemagglutinin__InfluenzaA__ABK40579

SEQ ID NO: 62424 - RNA, 1701 nt, Artificial Sequence
  derived and/or modified sequence opt1 from hemagglutinin__InfluenzaA__ABK40590
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggagcuacaucgccgagacccccaacagcgagaacgggaccugcuaccccggcuacuucgccgacuacgaggagcugcgcgagcagcuguccagcguguccagcuucgagcgguucgagaucuuccccaaggaguccagcuggccgaagcacaacgucaccaagggggugacggccuccugcagccacaagggcaaguccagcuucuaccgcaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccggaaggagaacgccuacgucagcgugguguccagccacuacaaccgccgguucacccccgagaucgcgaagcgcccgaagguccggaaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgagcauggacgagugcgacgccaagugccagacgccccagggcgccaucaacuccagccugccguuccagaacgugcaccccgugaccaucggcgagugccccaaguacguccgcuccaccaagcugcggauggugaccgggcuccgcaacauccccagcauccagucccggggccuguucggggccaucgccggcuucaucgagggcggcuggaccggcaugaucgacgggugguacggcuaccaccaccagaacgagcaggggagcggcuacgcggccgaccagaaguccacgcagaacgccaucaacgggaucaccaacaaggugaacagcaucaucgagaagaugaacacccaguucaccgccgucggcaaggaguucaacaagcuggagaagcgcauggagaaccucaacaagaagguggacgacggcuuccuggacaucuggacguacaacgccgagcugcucgugcugcuggagaacgagcggacccucgacuuccacgacuccaacgucaagaaccuguacgagaaggugaagaaccagcugaagaacaacgcgaaggagaucgggaacggcugcuucgaguucuaccacaagugcaacaacgagugcauggagagcgucaagaacgggaccuacgacuacccgaaguacuccgaggagagcaagcucaaccgcgagaagaucgacggcgugaagcuggagagcauggggguguaccagauccuggccaucuacuccaccgucgccagcucccucgugcugcuggugagccucggcgccaucuccuucuggaugugcagcaacggcucccugcagugccggaucugcaucuga

SEQ ID NO: 62425 - RNA, 1701 nt, Artificial Sequence; identical to SEQ ID NO: 61929
  derived and/or modified sequence opt1 from hemagglutinin__InfluenzaA__ABK40601

SEQ ID NO: 62426 - RNA, 1701 nt, Artificial Sequence; identical to SEQ ID NO: 61658
  derived and/or modified sequence opt1 from hemagglutinin__InfluenzaA__ABK40612

SEQ ID NO: 62427 - RNA, 1701 nt, Artificial Sequence
  derived and/or modified sequence opt1 from hemagglutinin__InfluenzaA__ABK40623
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcgguccacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucgccuacggcgccugcccgcgguacgucaagcagaacacgcucaagcuggccaccgggaugcgcaacgugcccgagaagcagacccggggcaucuucggggccaucgccggcuucaucgagaacgggugggagggcaugguggacggcugguacggguuccgccaccugaacagcgagggcaccgggcaggcggccgaccucaaguccacgcaggccgccaucaaccagaucaacggcaagcugaaccggcugaucgagaagaccaacgagaaguuccaccagaucgagaaggaguucagcgaggucgaggggcgcauccaggaccucgagaaguacgugaaggacaccaagaucgaccugugguccuacaacgccgagcugcucguggcgcuggagaaccagcacaccaucgaccugacggacagcgagaugaacaagcuguucgagcggacccgcaagcagcuccgcgagaacgccgaggacgucggcaacggcugcuucaagaucuaccacaagugcgacaacgccugcaucggguccauccggaacggcaccuacgaccacgacguguaccgcgacgaggcccugaacaaccgguuccagaucaagggggucgagcucaagagcggcuacaaggacuggauccuguggaucagcuucgccaucuccugcuuccugcucugcguggugcugcugggguucaucaugugggcgugccagaagggcaacauccgcugcaacaucugcaucuga

SEQ ID NO: 62428 - RNA, 1701 nt, Artificial Sequence; identical to SEQ ID NO: 61992
  derived and/or modified sequence opt1 from hemagglutinin__InfluenzaA__ABK40645

SEQ ID NO: 62429 - RNA, 1701 nt, Artificial Sequence
  derived and/or modified sequence opt1 from hemagglutinin__InfluenzaA__ABK40656
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcucccccaccgggcgcaucugcgacagcccccaccggauccuggacggcaagaacugcacccugaucgacgcccuccugggggacccccacugcgacggcuuccagaacaaggagugggaccuguucguggagcgcuccaaggccuacagcaacugcuacccguacgacgugcccgacuacgcgucccuccggagccuggucgccuccagcggcacgcuggaguucaccaacgagaacuucaacuggaccgggguggcccaggacggcaaguccuacagcugcaagcgcggguccgugaacagcuucuucucccggcucaacuggcugcacaagcuggaguacaaguaccccgcccucaacgucaccaugcccaacaacggcaaguucgacaagcuguacaucuggggcgugcaccacccgagcacggacuccgaccagaccagccuguacgugcgcgcguccgggaaggucaccgugagcaccaagcggagccagcagacggugauccccgacaucggcuaccgccccuggguccgggggcucuccagccgcaucuccaucuacuggaccaucgugaagcccggcgacauccugcugaucaacagcaccgggaaccucaucgccccgcggggcuacuucaagauccgcaacggcaaguccagcaucaugcgguccgacgcccccaucgggaacugcagcuccgagugcaucacccccaacggcagcauccccaacgacaagccguuccagaacgugaaccgcaucacguacgggaccugcccccgguacgucaagcagaacacccugaagcuggccaccggcaugcgcaacgugcccgagaagcagacgcgggggaucuucggcgccaucgcgggcuucaucgagaacgggugggagggcaugguggacgggugguacggcuuccgccaccagaacuccgaggggaccggccaggccgccgaccucaagagcacccaggccgccaucgaccagaucaacggcaagcugaaccggcuggucgagaagaccaacgagaaguuccaccagaucgagaaggaguucuccgagguggaggggcgcauccaggaccucgagaaguacguggaggacacgaagaucgaccuguggagcuacaacgcggagcugcucgucgcccuggagaaccagcacaccaucgaccugaccgacuccgagaugaacaagcuguucgagcggacccgcaagcagcuccgcgagaacgccgaggacaugggcaacgggugcuucaagaucuaccacaagugcgacaacgccugcaucggcagcauccggaacgggacguacgaccacgacguguaccgcgacgaggcccugaacaaccgguuccagaucaagggcgucgagcucaaguccggcuacaaggacuggauccuguggaucagcuucgcgaucuccugcuuccugcucugcguggugcugcugggguucaucaugugggccugccagaagggcaacauccgcugcaacaucugcaucuga

SEQ ID NO: 62430 - RNA, 1701 nt, Artificial Sequence
  derived and/or modified sequence opt1 from hemagglutinin__InfluenzaA__ABK40667
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaaguccuacgccugcaagcgcggcuccgugaacagcuucuucucccggcucaacuggcugcacaagcuggaguacaaguaccccgcgcucaacgucaccaugcccaacaacgacaaguucgacaagcuguacaucuggggcgugcaccaccccagcacggacuccgaccagaccagccuguacgugcaggccuccgggcgcgucaccgugagcaccaagcggagccagcagacggugaucccgaacaucggcucccgccccuggguccgggggaucagcucccgcaucagcaucuacuggaccaucgugaagcccggcgacauccuccugaucaacuccaccgggaaccugaucgcgccccggggcuacuucaagcuccgcaacggcaagagcuccaucaugcggagcgacgccccgaucgacaacugcaacuccgagugcaucacccccaacgggagcauccccaacgacaagcccuuccagaacgugaaccgcaucacguacggcgccugcccgcgguacgucaagcagaacacccugaagcuggccaccgggaugcgcaacgugcccgagaagcagacccggggcaucuucggggccaucgccggcuucaucgagaacggcugggaggggaugguggacggcugguacggguuccgccaccagaacuccgagggcacggggcaggccgccgaccucaagagcacccaggcggccaucgaccagaucaacggcaagcugaaccggcugaccgagaagaccaacgagaaguuccaccagaucgagaaggaguucuccgaggucgagggccgcauccaggaccucgagaaguacguggaggacacgaagaucgaccuguggagcuacaacgccgagcugcucguggcccuggagaaccagcacaccaucgaccugaccgacuccgagaugaacaagcuguucgagcggacccgcaagcagcuccgcgagaacgccgaggacauggggaacggcugcuucaagaucuaccacaagugcgacaacgcgugcaucgggagcauccggaacggcacguacaaccacgacgucuaccgcgacgaggcccugaacaaccgguuccagaucaaggggguggagcucaaguccggcuacaaggacuggauccuguggaucagcuucgccaucuccugcuuccugcucugcgucgugcugcugggcuucaucaugugggccugccagaaggggaacauccgcugcaacaucugcaucuga

SEQ ID NO: 62431 - RNA, 1701 nt, Artificial Sequence; identical to SEQ ID NO: 62074
  derived and/or modified sequence opt1 from hemagglutinin__InfluenzaA__ABK40678

SEQ ID NO: 62432 - RNA, 1698 nt, Artificial Sequence
  derived and/or modified sequence opt1 from hemagglutinin__InfluenzaA__ABK40689
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacggucgccuccagccucgugcugcuggugucccucggggccaucagcuucuggaugugcuccaacggcagccugcagugccggaucugcaucuga

SEQ ID NO: 62433 - RNA, 1701 nt, Artificial Sequence; identical to SEQ ID NO: 61658
  derived and/or modified sequence opt1 from hemagglutinin__InfluenzaA__ABK40700

SEQ ID NO: 62434 - RNA, 1701 nt, Artificial Sequence; identical to SEQ ID NO: 61658
  derived and/or modified sequence opt1 from hemagglutinin__InfluenzaA__ABK40711

SEQ ID NO: 62435 - RNA, 1701 nt, Artificial Sequence
  derived and/or modified sequence opt1 from hemagglutinin__InfluenzaA__ABK40722
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacaacgaccagaucucccuguacgcccaggccccggggcgggugaccgugagcaccaagcgcagccagcagaccgucauccccaacaucggcucccggcccugggugcgcggcgugagcucccggaucagcaucuacuggacgaucgucaagcccggggacauccuccugaucaacugcaccggcaaccugaucgccccgcgcggguacuucaagauccgguccggcaagagcuccaucaugcgcagcgacgccuccaucggcaagugcaacagcgagugcaucacccccaacggguccauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacagcgagggcaccgggcaggccgcggaccugaaguccacgcaggccgccaucaaccagaucaacggcaagcucaaccgccugaucgagaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucuccuucgccaucagcugcuuccugcugugcgugguccuccugggcuucaucaugugggccugccagaaggggaacauccgcugcaacaucugcaucuga

SEQ ID NO: 62436 - RNA, 1701 nt, Artificial Sequence; identical to SEQ ID NO: 61658
  derived and/or modified sequence opt1 from hemagglutinin__InfluenzaA__ABK40733

SEQ ID NO: 62437 - RNA, 1701 nt, Artificial Sequence; identical to SEQ ID NO: 62313
  derived and/or modified sequence opt1 from hemagglutinin__InfluenzaA__ABK40744

SEQ ID NO: 62438 - RNA, 1701 nt, Artificial Sequence; identical to SEQ ID NO: 61923
  derived and/or modified sequence opt1 from hemagglutinin__InfluenzaA__ABK79948

SEQ ID NO: 62439 - RNA, 1698 nt, Artificial Sequence; identical to SEQ ID NO: 62212
  derived and/or modified sequence opt1 from hemagglutinin__InfluenzaA__ABK79959

SEQ ID NO: 62440 - RNA, 1701 nt, Artificial Sequence
  derived and/or modified sequence opt1 from hemagglutinin__InfluenzaA__ABK79970
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaagaaguccuggagcuacaucgccgagacccccaaccccaagaacggcacgugcuaccccggcuacuucgccgacuacgaggagcuccgggagcagcugagcuccgugagcuccuucgagcgcuucgagaucuucccgaaggacagcuccuggcccaaccacaccgucaccaagggggugaccgccagcugcucccacaacggcaagagcuccuucuacaagaaccugcucuggcugacggagaagaacgggcuguaccccaaccucagcaaguccuacgugaacaagaagggcaaggagguccuggugcuguggggcgugcaccaccccagcaacaugggggaccagcgggccaucuaccacaaggagaacgcguacgucagcgugcucuccagccacuacucccgccgguucaccccggagaucgcccgccggcccaaggugcgcgaccaggagggccggaucaacuacuacuggacccugcuggagcccggggacaccaucaucuucgaggccaacggcaaccucaucgcccccugguacgccuucgcgcugagccgcggguucggcuccggcaucaucaucagcaacgccuccaugggggagugcgacgccaagugccagacgccgcagggcgccaucaacagcucccugcccuuccagaacguccaccccgugaccaucggggagugccccaaguacgugcggagcaccaagcuccgcauggucaccggccugcggaacgugccguccauccagagccgcgggcuguucggcgccaucgcgggcuucaucgagggcggguggacggggaugaucgacggcugguacggguaccaccaccagaacgagcagggcuccggcuacgccgccgaccagaaguccacccagaacgccaucaacgggaucaccaacaaggugaacagcaucaucgagaagaugaacacccaguucacggccgucggcaaggaguucaacaagcucgagcggcgcauggagaaccugaacaagaagguggacgacggguuccuggacaucuggaccuacaacgcggagcuccuggugcugcucgagaacgagcggacccuggacuuccacgacagcaacgucaagaaccuguacgagaaggugaagaaccagcucaagaacaacgccaaggagaucggcaacgggugcuucgaguucuaccacaagugcaacaacgagugcauggaguccgucaagaacggcaccuacgacuaccccaaguacagcaaggaguccaagcugaaccgcgagaagaucgacggcgugaagcuggagagcauggggguguaccagauccucgccaucuacagcacggucgccuccagccuggugcugcucgugucccugggcgccaucagcuucuggaugugcuccaacgggagccugcagugccggaucugcaucuga

SEQ ID NO: 62441 - RNA, 1701 nt, Artificial Sequence
  derived and/or modified sequence opt1 from hemagglutinin__InfluenzaA__ABK79981
augaagaccaucaucgcccugagcuacauccucugccugguguucacccagaagcugcccggcaacgacaacuccacggccacccucugccuggggcaccacgcggucccgaacggcacccuggugaagaccaucacgaacgaccagaucgaggugaccaacgccaccgagcucguccagagcuccagcaccgggggcaucugcgacagcccccaccagauccuggacggggagaacugcacgcugaucgacgcccuccugggcgacccccacugcgacggcuuccagaacaaggagugggaccuguucguggagcgcagcaaggccuacuccaacugcuaccccuacgacgugccggacuacgccagccuccggucccuggucgcgagcuccgggacccuggaguucaacaacgagagcuucaacuggaccggcguggcccagaacgggaccuccagcgccugcaagcgccgguccaacaagagcuucuucucccgccucaacuggcugcaccagcugaaguacaaguaccccgcccucaacgugacgaugcccaacaacgagaaguucgacaagcuguacaucuggggcguccaccaccccagcaccgacuccgaccagaucagccuguacgcgcaggccccggggcgggugaccgugagcaccaagcgcucccagcagacggucauccccaacaucggcagccggcccugggugcgcggcguguccagccggaucuccaucuacuggaccaucgucaagcccggggacauccuccugaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucacguacggcgccugcccgcgcuacgugaagcagaacacccucaagcuggcgaccgggaugcggaacguccccgagaagcagacccgcggcaucuucggggccaucgccggcuucaucgagaacggcugggaggggaugguggacggcugguacggguuccggcaccagaacuccgagggcacggggcaggccgccgaccugaaguccacccaggcggccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacacgaucgaccugaccgacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 62442 - RNA, 1701 nt, Artificial Sequence; identical to SEQ ID NO: 61658
  derived and/or modified sequence opt1 from hemagglutinin__InfluenzaA__ABK79992

SEQ ID NO: 62443 - RNA, 1701 nt, Artificial Sequence; identical to SEQ ID NO: 61929
  derived and/or modified sequence opt1 from hemagglutinin__InfluenzaA__ABK80025

SEQ ID NO: 62444 - RNA, 1701 nt, Artificial Sequence; identical to SEQ ID NO: 61929
  derived and/or modified sequence opt1 from hemagglutinin__InfluenzaA__ABK80036

SEQ ID NO: 62445 - RNA, 1701 nt, Artificial Sequence; identical to SEQ ID NO: 61929
  derived and/or modified sequence opt1 from hemagglutinin__InfluenzaA__ABK80047

SEQ ID NO: 62446 - RNA, 1701 nt, Artificial Sequence; identical to SEQ ID NO: 61774
  derived and/or modified sequence opt1 from hemagglutinin__InfluenzaA__ABK80058

SEQ ID NO: 62447 - RNA, 1701 nt, Artificial Sequence
  derived and/or modified sequence opt1 from hemagglutinin__InfluenzaA__ABK80069
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcgguccacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccuggauccgcggggugagcucccggaucagcaucuacuggaccaucgucaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucgccuacggcgccugcccgcgguacgugaagcagaacacgcucaagcuggccaccgggaugcgcaacguccccgagaagcagacccggggcaucuucggggccaucgccggcuucaucgagaacgggugggagggcaugguggacggcugguacggguuccgccaccugaacagcgagggcaccgggcaggcggccgaccucaaguccacgcaggccgccaucaaccagaucaacggcaagcugaaccggcugaucgagaagaccaacgagaaguuccaccagaucgagaaggaguucagcgagguggaggggcgcauccaggaccucgagaaguacgucgaggacaccaagaucgaccugugguccuacaacgccgagcugcucguggcgcuggagaaccagcacaccaucgaccugacggacagcgagaugaacaagcuguucgagcggacccgcaagcagcuccgcgagaacgccgaggacgugggcaacggcugcuucaagaucuaccacaagugcgacaacgccugcaucggguccauccggaacggcaccuacgaccacgacgucuaccgcgacgaggcccugaacaaccgguuccagaucaaggggguggagcucaagagcggcuacaaggacuggauccuguggaucagcuucgccaucuccugcuuccugcucugcgucgugcugcugggguucaucaugugggcgugccagaagggcaacauccgcugcaacaucugcaucuga

SEQ ID NO: 62448 - RNA, 1701 nt, Artificial Sequence
  derived and/or modified sequence opt1 from hemagglutinin__InfluenzaA__ABK80080
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcgguccacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacaugggcaacggcugccugaagaucuaccacaagugcgacaacgccugcaucggguccauccggaacggcaccuacgaccacgacgucuaccgcgacgaggcccugaacaaccgguuccagaucaaggggguggagcucaagagcggcuacaaggacuggauccuguggaucagcuucgccaucuccugcuuccugcucugcgucgugcugcugggguucaucaugugggccugccagaagggcaacauccgcugcaacaucugcaucuga

SEQ ID NO: 62449 - RNA, 1701 nt, Artificial Sequence; identical to SEQ ID NO: 61658
  derived and/or modified sequence opt1 from hemagglutinin__InfluenzaA__ABK80091

SEQ ID NO: 62450 - RNA, 1701 nt, Artificial Sequence; identical to SEQ ID NO: 61658
  derived and/or modified sequence opt1 from hemagglutinin__InfluenzaA__ABK80102

SEQ ID NO: 62451 - RNA, 1701 nt, Artificial Sequence; identical to SEQ ID NO: 61059
  derived and/or modified sequence opt1 from hemagglutinin__InfluenzaA__ABK80113

SEQ ID NO: 62452 - RNA, 1701 nt, Artificial Sequence
  derived and/or modified sequence opt1 from hemagglutinin__InfluenzaA__ABK80124
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaagaacuggauccucuggaucagcuucgccaucagcugcuuccugcugugcaucgugcuccugggcuucaucaugugggccugccagaaggggaacauccggugcaacaucugcaucuga

SEQ ID NO: 62453 - RNA, 1701 nt, Artificial Sequence; identical to SEQ ID NO: 61059
  derived and/or modified sequence opt1 from hemagglutinin__InfluenzaA__ABK80135

SEQ ID NO: 62454 - RNA, 1701 nt, Artificial Sequence; identical to SEQ ID NO: 61059
  derived and/or modified sequence opt1 from hemagglutinin__InfluenzaA__ABK80146

SEQ ID NO: 62455 - RNA, 1701 nt, Artificial Sequence; identical to SEQ ID NO: 61059
  derived and/or modified sequence opt1 from hemagglutinin__InfluenzaA__ABK80157

SEQ ID NO: 62456 - RNA, 1701 nt, Artificial Sequence; identical to SEQ ID NO: 61570
  derived and/or modified sequence opt1 from hemagglutinin__InfluenzaA__ABK80168

SEQ ID NO: 62457 - RNA, 1701 nt, Artificial Sequence
  derived and/or modified sequence opt1 from hemagglutinin__InfluenzaA__ABK80179
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcgugcccaacgacaagcccuuccagaacgucaaccgcaucaccuacggcgccugcccgcgguacgugaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcucaaccggcugaucgagaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgccugcagaucaaggggguggagcucaaguccggcuacaaggacuggauccuguggaucagcuucgccaucagcugcuuccugcucugcaucguccugcugggcuucaucaugugggccugccagaaggggaacauccggugcaacaucugcaucuga

SEQ ID NO: 62458 - RNA, 1701 nt, Artificial Sequence; identical to SEQ ID NO: 61570
  derived and/or modified sequence opt1 from hemagglutinin__InfluenzaA__ABK80190

SEQ ID NO: 62459 - RNA, 1701 nt, Artificial Sequence; identical to SEQ ID NO: 62313
  derived and/or modified sequence opt1 from hemagglutinin__InfluenzaA__ABK80201

SEQ ID NO: 62460 - RNA, 1701 nt, Artificial Sequence
  derived and/or modified sequence opt1 from hemagglutinin__InfluenzaA__ABK80212
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaagaacuggauccuguggaucagcuucgccaucagcugcuuccuccugugcgucgcccugcucggguucaucaugugggccugccagaagggcaacauccggugcaacaucugcaucuga

SEQ ID NO: 62461 - RNA, 1701 nt, Artificial Sequence; identical to SEQ ID NO: 61524
  derived and/or modified sequence opt1 from hemagglutinin__InfluenzaA__ABK80223

SEQ ID NO: 62462 - RNA, 1701 nt, Artificial Sequence
  derived and/or modified sequence opt1 from hemagglutinin__InfluenzaA__ABK80234
augcgcaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcggagcaaggccuacuccaacugcuaccccuacgacgugccggaccacgcgagccugcgcucccucgucgccagcuccgggacgcuggaguucaacaacgagagcuucgacuggaccggcgugacccagaacgggaccuccagcgccugcaagcggcgcuccaacaagagcuucuucucccggcugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccgcaucaccgugagcacgaagcggucccagcagaccgugaucccgaacaucggcagccgcccccggguccgcgacguguccagccggaucuccaucuacuggaccaucgugaagcccggggacauccugcucaucaacagcaccggcaaccugaucgcgccccgcggguacuucaagauccgguccggcaagagcuccaucaugcgcagcgacgccccgaucggcaagugcaacuccgagugcaucacgcccaacgggagcauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucagcuucgccaucagcugcuuccuccugugcgucgcccugcucggguucaucaugugggccugccagaagggcaacauccgcugcaacaucugcaucuga

SEQ ID NO: 62463 - RNA, 1701 nt, Artificial Sequence
  derived and/or modified sequence opt1 from hemagglutinin__InfluenzaA__ABK80245
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggcccacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaaccagagcuucuucucccgccugaacuggcucacgcaccugaaguucaaguaccccgcccugaacgugaccaugcccaacaacgagaaguucgacaagcucuacaucuggggcgugcaccaccccgggaccgacagcgaccagaucucccuguacgcgcaggccccgggccggaucaccgucagcacgaagcgcagccagcagaccgugauccccaacaucggcucccggccccgcgugcgggacaucagcucccgcaucagcaucuacuggaccaucgucaagcccggggacauccugcucaucaacuccaccggcaaccugaucgccccgcggggguacuucaagauccgcagcggcaaguccagcaucaugaaguccgacgcccccaucggcaagugcaacagcgagugcaucacgcccaacggguccauccccaacgacaagccguuccagaacgugaaccggaucaccuacggcgccugcccccgcuacgugaagcagaacacccugaagcucgcgaccgggaugcggaacguccccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacguguaccgcgacgaggcccucaacaaccgguuccagaucaagggcgucgagcugaaguccggcuacaaggacuggauccuguggaucuccuucgccaucagcugccuccugcugugcguggcccuccugggguucaucaugugggccugccagaagggcaacauccgcugcaacaucugcaucuga

SEQ ID NO: 62464 - RNA, 1701 nt, Artificial Sequence; identical to SEQ ID NO: 62463
  derived and/or modified sequence opt1 from hemagglutinin__InfluenzaA__ABK80256

SEQ ID NO: 62465 - RNA, 1701 nt, Artificial Sequence; identical to SEQ ID NO: 61620
  derived and/or modified sequence opt1 from hemagglutinin__InfluenzaA__ABK80267

SEQ ID NO: 62466 - RNA, 1701 nt, Artificial Sequence; identical to SEQ ID NO: 61641
  derived and/or modified sequence opt1 from hemagglutinin__InfluenzaA__ABK80278

SEQ ID NO: 62467 - RNA, 1701 nt, Artificial Sequence
  derived and/or modified sequence opt1 from hemagglutinin__InfluenzaA__ABK80289
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62468 - RNA, 1701 nt, Artificial Sequence; identical to SEQ ID NO: 61059
  derived and/or modified sequence opt1 from hemagglutinin__InfluenzaA__ABK80300

SEQ ID NO: 62469 - RNA, 1701 nt, Artificial Sequence; identical to SEQ ID NO: 61059
  derived and/or modified sequence opt1 from hemagglutinin__InfluenzaA__ABK80311

SEQ ID NO: 62470 - RNA, 1707 nt, Artificial Sequence
  derived and/or modified sequence opt1 from hemagglutinin__InfluenzaA__ABL07019
auggagaagaucgugcugcuccugagcaucgucucccuggucaagagcgaccagaucugcaucggcuaccacgccaacaacuccaccgagcaggucgacaccaucauggagaagaacgugacggugacccacgcccaggacauccucgagaagacccacaacgggaagcugugcgaccuggacggcgugaagccccucauccugcgcgacugcagcguggcgggguggcugcucggcaacccgaugugcgacgaguucaucaacgugcccgagugguccuacaucguggagaaggccaaccccaccaacgaccugugcuaccccgggagcuucaacgacuacgaggagcugaagcaccuccugucccggaucaaccacuucgagaagauccagaucauccccaagagcuccuggagcgaccacgaggccuccagcggcgucuccagcgccugcccguaccugggcucccccagcuucuuccgcaacgugguguggcucacgaagaagaacuccaccuaccccaccaucaagaaguccuacaacaacaccaaccaggaggaccugcugguccucugggggauccaccacccgaacaacgaggccgagcagacgcggcuguaccagaaccccaccaccuacaucuccaucggcaccagcacgcugaaccagcgccucgugcccaagaucgcgacccggagcaaggugaacgggcaguccggccgcauggaguucuucuggaccauccugaagcccaacgacgccaucaacuucgagagcaacgggaacuucaucgccccggaguacgccuacaagaucgucaagaagggcgacuccgcgaucaugaaguccgagcuggaguacagcaacugcaacaccaagugccagacgcccaugggcgccaucaacagcuccaugcccuuccacaacauccacccccucaccaucggggagugcccgaaguacgucaagagcaaccggcuggugcuggccaccggccuccgcaacagcccccagcgggagagccgccggaagaagcgcgggcuguucggcgccaucgccggcuucaucgagggcggguggcaggggaugguggacggcugguacggguaccaccacuccaacgagcagggcagcggcuacgcggccgacaaggaguccacccagaaggccaucgacggggugacgaacaaggugaacagcaucaucgacaagaugaacacccaguucgaggccgucggccgggaguucaacaaccuggagcgccggaucgagaaccucaacaagaagauggaggacggguuccuggacguguggaccuacaacgccgagcugcucgugcugauggagaacgagcgcacccuggacuuccacgacuccaacgucaagaaccucuacgacaaggugcggcugcagcugcgcgacaacgcgaaggagcucggcaacgggugcuucgaguucuaccacaagugcgacaacgagugcauggagagcauccggaacggcacguacaacuacccccaguacuccgaggaggcccgccugaagcgggaggagaucagcggcgucaagcuggaguccaucgggaccuaccagauccucagcaucuacagcaccguggccuccagccuggcccuggccaucaugaucgcgggccucucccuguggaugugcagcaacgggucccugcagugccgcaucugcaucuga

SEQ ID NO: 62471 - RNA, 1707 nt, Artificial Sequence
  derived and/or modified sequence opt1 from hemagglutinin__InfluenzaA__ABL07030
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccaccaacgaccugugcuaccccggguccuucaacgacuacgaggagcugaagcaccuccugagccggaucaaccacuucgagaagauccagaucaucccgaaguccagcugguccgaccacgaggccagcuccggcgucagcuccgccugccccuaccugggcagccccuccuucuuccgcaacgugguguggcucaucaagaagaacagcacguaccccaccaucaagaaguccuacaacaacaccaaccaggaggaccugcugguccucugggggauccaccacccgaacgacgcggccgagcagacccggcuguaccagaaccccacgaccuacaucagcaucggcaccuccacccugaaccagcgccucgugcccaagaucgccacgcggagcaaggugaacgggcagagcggccgcauggaguucuucugggccauccugaagcccaacgacgcgaucaacuucgaguccaacgggaacuucaucgccccggaguacgccuacaagaucgucaagaagggcgacagcgccaucaugaaguccgagcuggaguacggcaacugcaacaccaagugccagacccccaugggggccaucaacagcuccaugcccuuccacaacauccacccccucaccaucggcgagugcccgaaguacgugaaguccaaccggcuggugcuggcgacggggcuccgcaacagcccccagcgggagagccgccggaagaagcgcggccuguucggcgccaucgccggguucaucgagggcggguggcagggcauggucgacgggugguacggcuaccaccacuccaacgagcagggcagcggguacgccgccgacaaggaguccacccagaaggcgaucgacggcgugaccaacaaggugaacagcaucaucgacaagaugaacacccaguucgaggccgucgggcgggaguucaacaaccuggagcgccggaucgagaaccucaacaagaagauggaggacggcuuccuggacguguggacguacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacaacgagugcauggagagcauccggaacggcaccuacaacuacccccaguacuccgaggaggcccgccugaagcgggaggagaucagcggggucaagcuggaguccaucggcaccuaccagauccucagcaucuacuccacgguggcgagcagccuggcccuggccaucaugaucgccgggcucucccuguggaugugcagcaacggcucccugcagugccgcaucugcaucuga

SEQ ID NO: 62472 - RNA, 1707 nt, Artificial Sequence
  derived and/or modified sequence opt1 from hemagglutinin__InfluenzaA__ABL10088
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccacgaucaagcggagcuacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccgaggugaacgggcagagcggccggauggaguucuucuggacgauccucaagcccaacgacgccaucaacuucgagagcaacgggaacuucguggcgcccgaguacgccuacaagaucgucaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgugaaguccaaccgccucgugcuggccaccgggcugcggaacagcccgcagcgcgagcggcgccggaagaagcgcggccucuucggcgccaucgcgggguucaucgagggcggguggcagggcauggucgacgggugguacggcuaccaccacuccaacgagcagggcagcggguacgccgccaacaaggaguccacccagaaggccaucgacggcgugaccaacaaggugaacagcaucaucgacaagaugaacacgcaguucgaggccgucgggcgggaguucaacaaccuggagcgccggaucgagaaccugaacaagaagauggaggacggcuuccucgacguguggaccuacaacgcggagcugcugguccucauggagaacgagcgcacccuggacuuccacgacuccaacgugaagaaccuguacgacaaggugcggcuccagcugcgcgacaacgccaaggagcuggggaacggcugcuucgaguucuaccacaagugcgacaacgagugcauggagagcguccggaacggcaccuacgacuacccccaguacuccgaggaggcccgccucaagcgcgaggagaucagcggggugaagcuggaguccaucggcaucuaccagauccugagcaucuacuccacgguggccagcucccucgcccuggcgaucauggucgccgggcugagccucuggaugugcagcaacggcucccugcagugccggaucugcaucuga

SEQ ID NO: 62473 - RNA, 1707 nt, Artificial Sequence
  derived and/or modified sequence opt1 from hemagglutinin__InfluenzaA__ABL31766
auggagaagaucgugcugcuccuggccaucgucagcuucgugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccaccaacgaccucugcuaccccggguccuucaacgacuacgaggagcugaagcaccuccugagccggaucaaccacuucgagaagauccagaucaucccgaaguccagcugguccgaccacgaggccagcuccggcgucagcuccgccugccccuaccugggcagccccuccuucuuccgcaacgugguguggcugaucaagaagaacagcacguaccccaccaucaagaaguccuacaacaacaccaaccaggaggaccuccugguccugugggggauccaccacccgaacgacgcggccgagcagacccggcucuaccagaaccccacgaccuacaucagcaucggcaccuccacccugaaccagcgccuggugcccaagaucgccacgcggagcaaggugaacgggcagagcggccgcauggaguucuucugggccauccucaagcccaacgacgcgaucaacuucgaguccaacgggaacuucaucgccccggaguacgccuacaagaucgucaagaagggcgacagcgccaucaugaaguccgagcuggaguacggcaacugcaacaccaagugccagacccccaugggggccaucaacagcuccaugcccuuccacaacauccacccccugaccaucggcgagugcccgaaguacgugaaguccaaccggcucgugcuggcgacggggcugcgcaacagcccccagcgggagagccgccggaagaagcgcggccucuucggcgccaucgccggguucaucgagggcggguggcagggcauggucgacgggugguacggcuaccaccacuccaacgagcagggcagcggguacgccgccgacaaggaguccacccagaaggcgaucgacggcgugaccaacaaggugaacagcaucaucgacaagaugaacacccaguucgaggccgucgggcgggaguucaacaaccuggagcgccggaucgagaaccugaacaagaagauggaggacggcuuccucgacguguggacguacaacgccgagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcauccggaacggcaccuacaacuacccccaguacuccgaggaggcccgccucaagcgggaggagaucagcggggucaagcuggaguccaucggcaccuaccagauccugagcaucuacuccacgguggcgagcagccucgcccuggccaucaugaucgccgggcugucccucuggaugugcagcaacggcucccugcagugccgcaucugcaucuga

SEQ ID NO: 62474 - RNA, 1707 nt, Artificial Sequence
  derived and/or modified sequence opt1 from hemagglutinin__InfluenzaA__ABL31780
auggagaagaucgugcugcuccugagcaucgucucccuggugaaguccgaccagaucugcaucggcuaccacgccaacaacuccaccgagcaggucgacaccaucauggagaagaacgugacggugacccacgcccaggacauccucgagaagacccacaacgggaagcugugcgaccuggacggcgugaagccccucauccugcgcgacugcagcgucgcgggguggcugcucggcaacccgaugugcgacgaguucaucaacgugcccgagugguccuacaucguggagaaggccaaccccaccaacgaccugugcuaccccgggagcuucaacgacuacgaggagcugaagcaccuccugucccggaucaaccacuucgagaagauccagaucaucccgaagggcagcugguccgaccacgaggccagcuccggcgucagcuccgccugccccuaccugcgcagccccuccuucuuccggaacgugguguggcucaucaagaagaacagcacguaccccaccaucaagaaguccuacaacaacaccaaccaggaggaccugcugguccucugggggauccaccacccgaacaacgaggccgagcagacccgccuguaccagaaccccacgaccuacaucagcaucggcaccuccacccugaaccagcggcucgugcccaagaucgcgacgcgcagcaaggugaacgggcagagcggccggauggaguucuucuggaccauccugaagcccaacgacgccaucaacuucgaguccaacgggaacuucaucgccccggaguacgccuacaagaucgucaagaagggcgacagcgcgaucaugaaguccgagcuggaguacggcaacugcaacaccaagugccagacccccaugggggccaucaacagcuccaugcccuuccacaacauccacccccucacgaucggcgagugcccgaaguacgucaagagcaaccgccuggugcuggccaccgggcuccggaacagcccccagcgcgagagccggcgcaagaagcggggccuguucggcgccaucgccggguucaucgagggcggguggcagggcaugguggacgggugguacggcuaccaccacuccaacgagcagggcagcggguacgcggccgacaaggaguccacccagaaggccaucgacggcgugaccaacaaggugaacagcaucaucgacaagaugaacacgcaguucgaggccgucgggcgcgaguucaacaaccuggagcggcgcaucgagaaccucaacaagaagauggaggacggcuuccuggacguguggaccuacaacgccgagcugcucgugcugauggagaacgagcggacccuggacuuccacgacuccaacgucaagaaccucuacgacaaggugcgccugcagcugcgggacaacgcgaaggagcucgggaacggcugcuucgaguucuaccacaagugcgacaacgagugcauggagagcauccgcaacggcaccuacaacuacccccaguacuccgaggaggcccggcugaagcgcgaggagaucagcggggucaagcuggaguccaucggcacguaccagauccucagcaucuacuccaccguggccagcagccuggcccuggccaucaugaucgcggggcucucccuguggaugugcagcaacggcucccugcagugccgcaucugcaucuga

SEQ ID NO: 62475 - RNA, 1701 nt, Artificial Sequence
  derived and/or modified sequence opt1 from hemagglutinin__InfluenzaA__ABL67165
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccuccgggaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggaccacgcgucccugcggagccucgucgccuccagcggcacgcuggaguucaacaacgaguccuucgacuggaccggggugacccagaacggcaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccagcgggcggaucaccguguccacgaagcgcagccagcagaccgugaucccgaacaucggcucccggccccgcguccgggacgugagcucccgcaucagcaucuacuggaccaucgugaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagaagacgcgggggaucuucggcgccaucgccggguucaucgagaacggcugggagggcauggucgacgggugguacggcuuccgccaccagaacagcgaggggaccggccaggccgccgaccugaaguccacccaggcggccaucaaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcucaagagcggcuacaaggacuggauccuguggaucagcuucgccaucuccugcuuccugcugugcgucgcccugcucggcuucaucaugugggccugccagaaggggaacauccggugcaacaucugcaucuga

SEQ ID NO: 62476 - RNA, 1701 nt, Artificial Sequence
  derived and/or modified sequence opt1 from hemagglutinin__InfluenzaA__ABL67176
augaagaccaucaucgcccugagcuacauccucugccugguguucacccagaagcugcccggcaacgacaacuccacggccacccucugccuggggcaccacgcggucccgaacggcacccuggugaagaccaucacgaacgaccagaucgaggugaccaacgccaccgagcucguccagagcuccagcaccgggggcaucugcgacagcccccaccagauccuggacggggagaacugcacgcugaucgacgcccuccugggcgacccccacugcgacggcuuccagaacaaggagugggaccuguucguggagcgcagccgggccuacuccaacugcuaccccuacgacgugccggacuacgccagccuccgcucccuggucgcgagcuccgggacccuggaguucaacaacgagagcuucaacuggaccggcguggcccagaacgggaccuccagcgccugcaagcggcgcuccaacaagagcuucuucucccggcucaacuggcugcaccagcugaaguacaaguaccccgcccucaacgugacgaugcccaacaacgagaaguucgacaagcuguacaucuggggcguccaccaccccagcaccgacuccgaccagaucagccuguacgcgcaggccccggggcgcgugaccgugagcaccaagcggucccagcagacggucauccccaacaucggcagccgccccugggugcggggcguguccagccgcaucuccaucuacuggaccaucgucaagcccggggacauccuccugaucaacugcaccggcaaccugaucgccccgcggggguacuucaagauccgcagcggcaaguccagcaucaugcgguccgacgccagcaucggcaagugcaacuccgagugcaucacccccaacgggagcauccccaacgacaagcccuuccagaacgugaaccgcaucacguacggcgccugcccgcgguacgugaagcagaacacccucaagcuggcgaccgggaugcgcaacguccccgagaagcagacccggggcaucuucggggccaucgccggcuucaucgagaacggcugggaggggaugguggacggcugguacggguuccgccaccagaacuccgagggcacggggcaggccgccgaccugaaguccacccaggcggccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacacgaucgaccugaccgacuccgagaugaacaagcuguucgagcggaccaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcgugguccuccugggcuucaucaugugggccugccagaaggggaacauccggugcaacaucugcaucuga

SEQ ID NO: 62477 - RNA, 1701 nt, Artificial Sequence; identical to SEQ ID NO: 62440
  derived and/or modified sequence opt1 from hemagglutinin__InfluenzaA__ABL67187

SEQ ID NO: 62478 - RNA, 1701 nt, Artificial Sequence; identical to SEQ ID NO: 62395
  derived and/or modified sequence opt1 from hemagglutinin__InfluenzaA__ABL67209

SEQ ID NO: 62479 - RNA, 1701 nt, Artificial Sequence; identical to SEQ ID NO: 61929
  derived and/or modified sequence opt1 from hemagglutinin__InfluenzaA__ABL67253

SEQ ID NO: 62480 - RNA, 1701 nt, Artificial Sequence
  derived and/or modified sequence opt1 from hemagglutinin__InfluenzaA__ABL67264
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggagcuacaucgccgagacccccaacagcgagaacgggaccugcuaccccggcuacuucgccgacuacgaggagcugcgcgagcagcuguccagcguguccagcuucgagcgguucgagaucuuccccaaggaguccagcuggccgaagcacaacgucaccaagggggugacggccuccugcagccacaagggcaaguccagcuucuaccgcaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccggaaggagaacgccuacgucagcgugguguccagccacuacaaccgccgguucacccccgagaucgcgaagcgcccgaagguccggaaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgagcauggacgagugcgacgccaagugccagacgccccagggcgccaucaacuccagcuucccguuccagaacgugcaccccgugaccaucggcgagugccccaaguacguccgcuccaccaagcugcggauggugaccgggcugcgcaacauccccagcauccagucccggggccucuucggggccaucgccggcuucaucgagggcggcuggaccggcaugaucgacgggugguacggcuaccaccaccagaacgagcaggggagcggcuacgcggccgaccagaaguccacgcagaacgccaucaacgggaucaccaacaaggugaacagcaucaucgagaagaugaacacccaguucaccgccgucggcaaggaguucaacaagcuggagaagcgcauggagaaccugaacaagaagguggacgacggcuuccucgacaucuggacguacaacgccgagcugcuggugcuccuggagaacgagcggacccuggacuuccacgacuccaacgucaagaaccucuacgagaaggucaagagccagcugaagaacaacgcgaaggagaucgggaacggcugcuucgaguucuaccacaagugcaacaacgagugcauggaguccgugaagaacgggaccuacgacuacccgaaguacagcgaggagagcaagcugaaccgcgagaagaucgacggcgugaagcucgaguccauggggguguaccagauccuggccaucuacagcaccgucgccuccagccuggugcuccuggugucccugggcgccaucagcuucuggaugugcuccaacggcagccuccagugccggaucugcaucuga

SEQ ID NO: 62481 - RNA, 1701 nt, Artificial Sequence
  derived and/or modified sequence opt1 from hemagglutinin__InfluenzaA__ABL67275
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacgucggcaacggcugcuucaagaucuaccacaagugcgacaacgccugcaucggguccauccggaacggcaccuacgaccacgacguguaccgcgacgaggcccugaacaaccgguuccagaucaagggggucaagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 62482 - RNA, 1701 nt, Artificial Sequence
  derived and/or modified sequence opt1 from hemagglutinin__InfluenzaA__ABL67286
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaaguccggggacauccuccugaucaacuccaccggcaaccugaucgcgccccggggguacuucaagauccgcagcggcaaguccagcaucaugcgguccgacgcccccaucggcaagugcaacagcgagugcaucaccccgaacggguccauccccaacgacaagcccuuccagaacgugaaccgcaucaccuacggccccugcccgcgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacagcgagggcaccgggcaggccgccgaccugaaguccacgcaggccgcgaucaaccagaucaacggcaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgccugcaucggguccauccgcaacggcaccuacgaccacgacguguaccgggacgaggcgcugaacaaccgcuuccagaucaagggggucgagcucaagagcggcuacaaggacuggauccuguggaucagcuucgccaucuccugcuuccugcugugcaucgugcuccugggcuucaucaugugggccugccagaaggggaacauccggugcaacaucugcaucuga

SEQ ID NO: 62483 - RNA, 1701 nt, Artificial Sequence; identical to SEQ ID NO: 62013
  derived and/or modified sequence opt1 from hemagglutinin__InfluenzaA__ABL67297

SEQ ID NO: 62484 - RNA, 1701 nt, Artificial Sequence
  derived and/or modified sequence opt1 from hemagglutinin__InfluenzaA__ABL67308
augaagaccaucaucgcccugagcuacauccucugccugguguucgcccagaagcugcccggcaacgacaacuccauggcgacccucugccuggggcaccacgccgucccgaacggcacgcuggugaagaccaucaccaacgaccagaucgaggugaccaacgccacggagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcgguccaaggccuacuccagcugcuaccccuacgacgugccggacuacgucucccuccgcagccugguggcguccagcggcacccuggaguucaacaacgaguccuucaacuggacggggguggcccagaacggcaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggaccgacuccgaccagaucagccuguacgcgcaggccagcgggcgcgugacggucuccaccaagcggagccagcagaccgugaucccgaacaucggcucccgccccugggugcggggcgucagcucccgcaucagcaucuacuggaccaucgugaagcccggggacauccuccugaucaacuccacgggcaaccugaucgcgccccggggguacuucaagauccgcagcggcaaguccagcaucaugcgguccgacgccccgaucgacaagugcaacagcgagugcaucacccccaacggcuccauccccaacgacaagcccuuccagaacgugaaccgcaucaccuacgggcucugcccgcgguacgucaagcagaacacccugaagcuggccacgggcaugcgcaacgugcccgagaagcagacccgggggaucuucggcgccaucgccggguucaucgagaacggcugggagggcaugauggacgggugguacggcuuccgccaccagaacagcgaggggaccggccaggccgccgaccucaaguccacccaggccgcgaucaaccagaucaacgggaagcugaaccggcugaucgagaagacgaacgagaaguuccaccagaucgagaaggaguucagcgagguggagggccgcauccaggaccucgagaaguacgucgaggacaccaagaucgaccugugguccuacaacgccgagcugcucguggcccuggagaaccagcacaccaucgaccugaccgacagcgagaugaacaagcuguucgagcggacgaagaagcagcuccgcgagaacgccgaggacaugggcaacgggugcuucaagaucuaccacaagugcgacaacgccugcaucggcuccauccgcaacgggaccuacgaccacgacguguaccgggacgaggcgcugaacaaccgcuuccagaucaagggcgucgagcucaagagcggguacaaggacuggauccuguggaucagcuucgccaucuccugcuuccugcucugcaucgugcugcugggcuucaucaugugggccugccagaagggcaacguccggugcaacaucugcaucuga

SEQ ID NO: 62485 - RNA, 1701 nt, Artificial Sequence; identical to SEQ ID NO: 61570
  derived and/or modified sequence opt1 from hemagglutinin__InfluenzaA__ABL67319

SEQ ID NO: 62486 - RNA, 1701 nt, Artificial Sequence; identical to SEQ ID NO: 62313
  derived and/or modified sequence opt1 from hemagglutinin__InfluenzaA__ABL67330

SEQ ID NO: 62487 - RNA, 1701 nt, Artificial Sequence; identical to SEQ ID NO: 61524
  derived and/or modified sequence opt1 from hemagglutinin__InfluenzaA__ABL67341

SEQ ID NO: 62488 - RNA, 1701 nt, Artificial Sequence; identical to SEQ ID NO: 61524
  derived and/or modified sequence opt1 from hemagglutinin__InfluenzaA__ABL67352

SEQ ID NO: 62489 - RNA, 1701 nt, Artificial Sequence; identical to SEQ ID NO: 61040
  derived and/or modified sequence opt1 from hemagglutinin__InfluenzaA__ABL67363

SEQ ID NO: 62490 - RNA, 1701 nt, Artificial Sequence
  derived and/or modified sequence opt1 from hemagglutinin__InfluenzaA__ABL67374
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggcccacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaaccagagcuucuucucccgccugaacuggcucacgcaccugaaguucaaguaccccgcccugaacgugaccaugcccaacaacgagaaguucgacaagcucuacaucuggggcgugcaccaccccgggaccgacagcgaccagaucucccuguacgcgcaggccccgggccggaucaccgucagcacgaagcgcagccagcagaccgugauccccaacaucggcucccggccccgcgugcgggacaucagcucccgcaucagcaucuacuggaccaucgucaagcccggggacauccugcucaucaacuccaccggcaaccugaucgccccgcggggguacuucaagaugcgcagcggcaaguccagcaucaugaaguccgacgcccccaucggcaagugcaacagcgagugcaucacgcccaacggguccauccccaacgacaagccguuccagaacgugaaccggaucaccuacggcgccugcccccgcuacgugaagcagaacacccugaagcucgcgaccgggaugcggaacguccccgagaagcagacgcgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucagcgagguggaggggcggauccaggaccuggagaaguacgucgaggacacgaagaucgaccugugguccuacaacgccgagcuccugguggcccuggagaaccagcacaccaucgaccucaccgacagcgagaugaacaagcuguucgagcgcaccaagaagcagcugcgggagaacgccgaggacaugggcgacgggugcuucaagaucuaccacaagugcgacaacgcgugcaucggcuccauccgcaacgggacguacgaccacgacguguaccgcgacgaggcccucaacaaccgguuccagaucaagggcgucgagcugaaguccggcuacaaggacuggauccuguggaucuccuucgccaucagcugccuccugcugugcguggcccuccugggguucaucaugugggccugccagaagggcaacauccgcugcaacaucugcaucuga

SEQ ID NO: 62491 - RNA, 1701 nt, Artificial Sequence; identical to SEQ ID NO: 61290
  derived and/or modified sequence opt1 from hemagglutinin__InfluenzaA__ABL67385

SEQ ID NO: 62492 - RNA, 1701 nt, Artificial Sequence; identical to SEQ ID NO: 61620
  derived and/or modified sequence opt1 from hemagglutinin__InfluenzaA__ABL67396

SEQ ID NO: 62493 - RNA, 1701 nt, Artificial Sequence; identical to SEQ ID NO: 61638
  derived and/or modified sequence opt1 from hemagglutinin__InfluenzaA__ABL67407

SEQ ID NO: 62494 - RNA, 1701 nt, Artificial Sequence
  derived and/or modified sequence opt1 from hemagglutinin__InfluenzaA__ABL67418
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcaacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62495 - RNA, 1707 nt, Artificial Sequence; identical to SEQ ID NO: 61036
  derived and/or modified sequence opt1 from hemagglutinin__InfluenzaA__ABL67781

SEQ ID NO: 62496 - RNA, 1707 nt, Artificial Sequence
  derived and/or modified sequence opt1 from hemagglutinin__InfluenzaA__ABL67794
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccacgaucaagcggagcuacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagagcaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacagcccgcagcgcgagaagcggcgcaagaagcggggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucgacaagaugaacacgcaguucgaggccguggggcgcgaguucaacaaccuggagcggcgcaucgagaaccugaacaagaagauggaggacggcuuccucgacgucuggaccuacaacgcggagcugcuggugcucauggagaacgagcggacccuggacuuccacgacuccaacgucaagaaccuguacgacaaggugcgccuccagcugcgggacaacgccaaggagcuggggaacggcugcuucgaguucuaccacaagugcgacaacgagugcauggagagcgugcgcaacggcaccuacgacuacccccaguacuccgaggaggcccggcucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccgcaucugcaucuga

SEQ ID NO: 62497 - RNA, 1707 nt, Artificial Sequence
  derived and/or modified sequence opt1 from hemagglutinin__InfluenzaA__ABL67816
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccacgaucaagcggagcuacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagagcaacgggaacuucaucgcgcccgaguacgccuacaagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacagcccgcagcgcgagcggcgccggaagaagcgcggccucuucggcgccaucgcgggguucaucgagggcggguggcagggcaugguggacgggugguacggcuaccaccacuccaacgagcagggcagcggguacgccgccgacaaggaguccacccagaaggccaucgacggcgucaccaacaaggugaacagcaucaucaacaagaugaacacgcaguucgaggccguggggcgggaguucaacaaccuggagcgccggaucgagaaccugaacaagaagauggaggacggcuuccucgacgucuggaccuacaacgcggagcugcuggugcucauggagaacgagcgcacccuggacuuccacgacuccaacgucaagaaccuguacgacaaggugcggcuccagcugcgcgacaacgccaaggagcuggggaacggcugcuucgaguucuaccacaagugcgacaacgagugcauggagagcgugcggaacggcaccuacgacuacccccaguacuccgaggaggcccgccucaagcgcgaggagaucagcggggucaagcuggaguccaucggcaucuaccagauccugagcaucuacuccacgguggccagcucccucgcccuggcgaucaugguggccgggcugagccucuggaugugcagcaacggcucccugcagugccggaucugcaucuga

SEQ ID NO: 62498 - RNA, 1707 nt, Artificial Sequence
  derived and/or modified sequence opt1 from hemagglutinin__InfluenzaA__ABL67827
auggagaagaucgugcugcuguucgccaucgucagccuggugaaguccgaccacaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggccagccugggcguguccagcgccugcccguaccagggcaaguccagcuucuuccgcaacguggucuggcugaucaagaagaacuccaccuaccccacgaucaagcggagcuacaacaacaccaaccaggaggaccuccuggugcugugggggauccaccaccccaacgacgcggccgagcagaccaagcucuaccagaacccgaccacguacaucuccgugggcaccagcacccugaaccagcgccuggucccccggaucgccacccgcuccaaggugaacgggcagagcggccggauggaguucuucuggacgauccucaagcccaacgacgccaucaacuucgagagcaacgggaacuucaucgcgcccgaguacgccuacgagaucgugaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgucaaguccaaccgccucgugcuggccaccgggcugcggaacagcccgcagaucgagcgccggcgcaagaagcggggccucuucggcgccaucgcgggguuccuggagggcggguggcagggcaugguggacgggugguacggcuaccaccacuccaacgagcagggcagcggguacgccgccgacaaggaguccacccagaaggccaucgacggcgucaccaacaaggugaacagcaucaucaacaagaugaacacgcaguucgaggccguggggcgcgaguucaacaaccuggagcggcgcaucgagaaccucaacaagaagauggaggacggcuuccuggacgucuggaccuacaacgcggagcugcucgugcugauggagaacgagcggacccuggacuuccacgacuccaacgucaagaaccucuacgacaaggugcgccugcagcugcgggacaacgccaaggagcucgggaacggcugcuucgaguucuaccacaagugcgacaacgagugcauggagagcgugcgcaacggcaccuacgacuacccccaguacuccgaggaggcccggcugaagcgcgaggagaucagcggggucaagcuggaguccaucggcaucuaccagauccucagcaucuacuccacgguggccagcucccuggcccuggcgaucaugguggccgggcucagccuguggaugugcagcaacggcucccugcagugccgcaucugcaucuga

SEQ ID NO: 62499 - RNA, 1701 nt, Artificial Sequence
  derived and/or modified sequence opt1 from hemagglutinin__InfluenzaA__ABM22015
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcgacaucugcaucuga

SEQ ID NO: 62500 - RNA, 1701 nt, Artificial Sequence
  derived and/or modified sequence opt1 from hemagglutinin__InfluenzaA__ABM22026
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagagcugguccuacaucgccgagacccccaaccccaagaacggcacgugcuaccccggcuacuucgccgacuacgaggagcuccgggagcagcugagcuccgugagcuccuucaagcgcuucgagaucuucccgaaggacagcuccuggcccaaccacaccgucaccaagggggugaccgccagcugcucccacaacggcaagagcuccuucuacaagaaccugcucuggcugacggagaagaacgggcuguaccccaaccucagcaaguccuacgugaacaagaagggcaaggagguccuggugcuguggggcgugcaccaccccagcaacaugggggaccagcgggccaucuaccacaaggagaacgcguacgucagcgugcucuccagccacuacucccgccgguucaccccggagaucgcccgccggcccaaggugcgcgaccaggagggccggaucaacuacuacuggacccugcuggagcccggggacaccaucaucuucgaggccaacggcaaccucaucgcccccugguacgccuucgcgcugagccgcggguucggcuccggcaucaucaucagcaacgccuccaugggggagugcgacgccaagugccagacgccgcagggcgccaucaacagcucccugcccuuccagaacguccaccccgugaccaucggggagugccccaaguacgugcggagcaccaagcuccgcauggucaccggccugcggaacgugccguccauccagagccgcgggcuguucggcgccaucgcgggcuucaucgagggcggguggacggggaugaucgacggcugguacggguaccaccaccagaacgagcagggcuccggcuacgccgccgaccagaaguccacccagaacgccaucaacgggaucaccaacaaggugaacagcaucaucgagaagaugaacacccaguucacggccgucggcaaggaguucaacaagcucgagcggcgcauggagaaccugaacaagaagguggacgacggguuccuggacaucuggaccuacaacgcggagcuccuggugcugcucgagaacgagcggacccuggacuuccacgacagcaacgucaagaaccuguacgagaaggugaagaaccagcucaagaacaacgccaaggagaucggcaacgggugcuucgaguucuaccacaagugcaacaacgagugcauggaguccgucaagaacggcaccuacgacuaccccaaguacagcaaggaguccaagcugaaccgcgagaagaucgacggcgugaagcuggagagcauggggguguaccagauccucgccaucuacagcacggucgccuccagccuggugcugcucgugucccugggcgccaucagcuucuggaugugcuccaacgggagccugcagugccggaucugcaucuga

SEQ ID NO: 62501 - RNA, 1701 nt, Artificial Sequence; identical to SEQ ID NO: 61641
  derived and/or modified sequence opt1 from hemagglutinin__InfluenzaA__ABM22037

SEQ ID NO: 62502 - RNA, 1701 nt, Artificial Sequence; identical to SEQ ID NO: 61059
  derived and/or modified sequence opt1 from hemagglutinin__InfluenzaA__ABM22059

SEQ ID NO: 62503 - RNA, 1701 nt, Artificial Sequence; identical to SEQ ID NO: 62313
  derived and/or modified sequence opt1 from hemagglutinin__InfluenzaA__ABM22070

SEQ ID NO: 62504 - RNA, 1701 nt, Artificial Sequence
  derived and/or modified sequence opt1 from hemagglutinin__InfluenzaA__ABM22081
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggaccacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacauccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 62505 - RNA, 1701 nt, Artificial Sequence
  derived and/or modified sequence opt1 from hemagglutinin__InfluenzaA__ABM22092
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggaccacgcgagccugcggucccucgucgccagcuccggcacgcuggaguucaacaacgagagcuucgacugggccggggugacccagaacggcaccuccagcgccugcaagcgccgguccaacaagagcuucuucucccgccugaacuggcucacccaccugaaguacaaguaccccgcgcugaacgugacgaugcccaacaacgagaaguucgacaagcucuacaucuggggcguccaccaccccgggaccgacagcgaccagaucucccuguacgcccaggccagcgggcggaucaccgugagcaccaagcgcucccagcagacggugaucccgaacaucggcagccggccccgcguccgggacguguccagccgcaucuccaucuacuggaccaucgugaagcccggcgacauccugcucaucaacagcaccgggaaccugaucgcgccccggggcuacuucaagauccgcuccgggaaguccuccaucaugcggagcgacgccccgaucggcaagugcaacuccgagugcaucacccccaacggcagcauccccaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggacgggccaggccgcggaccucaagagcacccaggccgccaucaaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgcggaggacauggggaacggcugcuucaagaucuaccacaagugcgacaacgccugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucagcugcuuccuccugugcgucgcccugcucggcuucaucaugugggcgugccagaaggggaacauccggugcaacaucugcaucuga

SEQ ID NO: 62506 - RNA, 1701 nt, Artificial Sequence; identical to SEQ ID NO: 62318
  derived and/or modified sequence opt1 from hemagglutinin__InfluenzaA__ABM22103

SEQ ID NO: 62507 - RNA, 1701 nt, Artificial Sequence; identical to SEQ ID NO: 61524
  derived and/or modified sequence opt1 from hemagglutinin__InfluenzaA__ABM22114

SEQ ID NO: 62508 - RNA, 1701 nt, Artificial Sequence; identical to SEQ ID NO: 62463
  derived and/or modified sequence opt1 from hemagglutinin__InfluenzaA__ABM22125

SEQ ID NO: 62509 - RNA, 1701 nt, Artificial Sequence
  derived and/or modified sequence opt1 from hemagglutinin__InfluenzaA__ABM22136
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaucgggaugcgcaacgugcccgagaagcagacccggggcaucuucggggccaucgccggcuucaucgagaacggcugggaggggaugguggacggcugguacggguuccgccaccagaacagcgagggcaucgggcaggccgccgaccugaaguccacgcaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucacggacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62510 - RNA, 1701 nt, Artificial Sequence; identical to SEQ ID NO: 61641
  derived and/or modified sequence opt1 from hemagglutinin__InfluenzaA__ABM22147

SEQ ID NO: 62511 - RNA, 1701 nt, Artificial Sequence; identical to SEQ ID NO: 61929
  derived and/or modified sequence opt1 from hemagglutinin__InfluenzaA__ABM22158

SEQ ID NO: 62512 - RNA, 1701 nt, Artificial Sequence; identical to SEQ ID NO: 61929
  derived and/or modified sequence opt1 from hemagglutinin__InfluenzaA__ABM22169

SEQ ID NO: 62513 - RNA, 1701 nt, Artificial Sequence; identical to SEQ ID NO: 61929
  derived and/or modified sequence opt1 from hemagglutinin__InfluenzaA__ABM22180

SEQ ID NO: 62514 - RNA, 1701 nt, Artificial Sequence; identical to SEQ ID NO: 61929
  derived and/or modified sequence opt1 from hemagglutinin__InfluenzaA__ABM22191

SEQ ID NO: 62515 - RNA, 1701 nt, Artificial Sequence; identical to SEQ ID NO: 61929
  derived and/or modified sequence opt1 from hemagglutinin__InfluenzaA__ABM22202

SEQ ID NO: 62516 - RNA, 1701 nt, Artificial Sequence; identical to SEQ ID NO: 61929
  derived and/or modified sequence opt1 from hemagglutinin__InfluenzaA__ABM22213

SEQ ID NO: 62517 - RNA, 1701 nt, Artificial Sequence; identical to SEQ ID NO: 61929
  derived and/or modified sequence opt1 from hemagglutinin__InfluenzaA__ABM22224

SEQ ID NO: 62518 - RNA, 1701 nt, Artificial Sequence; identical to SEQ ID NO: 61929
  derived and/or modified sequence opt1 from hemagglutinin__InfluenzaA__ABM22235

SEQ ID NO: 62519 - RNA, 1701 nt, Artificial Sequence
  derived and/or modified sequence opt1 from hemagglutinin__InfluenzaA__ABM22268
augaaggugaagcugcucguccugcugugcgccuucaccgccaccuacgcggacacgaucugcaucggcuaccacgccaacaacagcaccgacaccguggacaccgugcucgagaagaacgucacggugacccacuccgugaaccugcuggaggacagccacaacgggaagcucugccgccugaagggcaccgcgccccugcagcucgggaacugcuccgucgccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgugagcuccuucgagcgcuucgagaucuucccgaaggagagcuccuggcccaaccacaccgugaccaagggggucaccgccagcugcucccacaacggcaagagcuccuucuacaagaaccugcucuggcugacggagaagaacgggcuguaccccaaccucagcaaguccuacgugaacaacaaggagaaggaggugcugguccuguggggcgugcaccaccccagcaacaucggggaccagcgggccaucuaccacaccgagaacgccuacgugagcgucguguccagccacuacucccgccgguucaccccggagaucgcgaagcgccccaaggugcgggaccaggagggccgcaucaacuacuacuggacccuccuggagcccggcgacacgaucaucuucgaggccaacgggaaccugaucgcccccugguacgccuucgcccucagccggggcuucggguccggcaucaucaccagcaacgcguccaugggcgagugcgacgccaagugccagaccccgcagggggccaucaacagcucccugcccuuccagaacguccaccccgugaccaucggcgagugccccaaguacgugcgcagcacgaagcugcggauggucaccgggcuccgcaacaucccguccauccagagccggggccuguucggggccaucgccggcuucaucgagggcggguggaccggcaugaucgacgggugguacggcuaccaccaccagaacgagcagggguccggcuacgcggccgaccagaaguccacccagaacgccaucgacggcaucacgaacaaggugaacagcgugaucgagaagaugaacacccaguucaccgccgucgggaaggaguucaacaagcuggagcgccggauggagaaccucaacaagaagguggacgacggcuuccuggacaucuggaccuacaacgccgagcugcucguccugcuggagaacgagcgcacgcucgacuuccacgacagcaacgugaagaaccuguacgagaaggugaagaaccagcugaagaacaacgcgaaggagaucgggaacggcugcuucgaguucuaccacaagugcaacaacgagugcauggaguccgucaagaacgggaccuacgacuaccccaaguacagcgaggaguccaagcucaaccgggagaagaucgacggcgugaagcuggagagcaugggcguguaccagauccuggccaucuacagcaccgucgccuccagccucgugcugcuggugucccucggggccaucagcuucuggaugugcuccaacggcagccugcagugccgcaucugcaucuga

SEQ ID NO: 62520 - RNA, 1701 nt, Artificial Sequence
  derived and/or modified sequence opt1 from hemagglutinin__InfluenzaA__ABM22279
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggaccgccacaacgggaagcucugccggcugaagggcaccgcgccccugcagcucgggaacugcagcguggccggcuggauccuggggaacccggagugcgagucccuguucagcaaggaguccuggagcuacaucgccgagacccccaaccccgagaacggcacgugcuaccccggcuacuucgccgacuacgaggagcuccgcgagcagcuguccagcgucuccagcuucgagcgguucgagaucuucccgaaggaguccagcuggcccaaccacaccgugaccaagggggugaccgccuccugcagccacaacggcaaguccagcuucuacaagaaccugcucuggcugacggagaagaacgggcuguaccccaaccucuccaagagcuacgucaacaacaaggagaaggaggugcuggugcuguggggcguccaccaccccuccaacaucggggaccagcgcgccaucuaccacaccgagaacgcguacgugagcguggucagcucccacuacagccggcgcuucaccccggagaucgccaagcggcccaaggugcgcgaccaggagggccggaucaacuacuacuggacccuccuggagcccggcgacacgaucaucuucgaggccaacgggaaccugaucgcccccugguacgccuucgcgcucucccgcggcuucgggagcggcaucaucaccuccaacgccagcaugggcgacugcgacgccaagugccagaccccgcagggggccaucaacuccagccugcccuuccagaacgugcaccccgucaccaucggcgggugccccaaguacgugcgguccacgaagcugcgcauggugaccggccuccggaacaucccgagcauccagucccgcgggcuguucggcgccaucgcgggcuucaucgagggcggguggaccgggaugaucgacggcugguacggguaccaccaccagaacgagcagggcagcggcuacgccgccgacaagaaguccacccagaacgccaucgacgggaucacgaacaaggucaacagcgugaucgagaagaugaacacccaguucaccgccgugggcaaggaguucaacaagcuggagcggcgcauggagaaccucaacaagaaggucgacgacggguuccuggacaucuggaccuacaacgcggagcugcucgugcugcuggagaacgagcggacgcucgacuaccacgacuccaacgucaagaaccuguacgagaaggugaagaaccagcugaagaacaacgccaaggagaucggcaacgggugcuucgaguucuaccacaagugcaacaacgagugcauggagagcgugaagaacggcaccuacgacuaccccaaguacuccgaggagagcaagcucaagcgcgagaagaucgacggcgucaagcuggaguccauggggguguaccagauccuggccaucuacagcaccguggccagcucccucguccugcuggugagccucggcgccaucuccuucuggaugugcagcaacgggucccugcagugccggaucugcaucuga

SEQ ID NO: 62521 - RNA, 1701 nt, Artificial Sequence
  derived and/or modified sequence opt1 from hemagglutinin__InfluenzaA__ABM22290
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggagaacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucagccggggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcgcagcacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgaccagaaguccacccagaacgccaucgacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacagcaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacagcgaggaguccaagcucaaccgggagaagaucgacggcgucaagcuggagagcaugggcguguaccagauccuggccaucuacagcaccguggccuccagccucguccugcuggugucccucggggccaucagcuucuggaugugcuccaacggcagccugcagugccgcaucugcaucuga

SEQ ID NO: 62522 - RNA, 1701 nt, Artificial Sequence; identical to SEQ ID NO: 61263
  derived and/or modified sequence opt1 from hemagglutinin__InfluenzaA__ABM22301

SEQ ID NO: 62523 - RNA, 1701 nt, Artificial Sequence; identical to SEQ ID NO: 61263
  derived and/or modified sequence opt1 from hemagglutinin__InfluenzaA__ABM22312

SEQ ID NO: 62524 - RNA, 1701 nt, Artificial Sequence; identical to SEQ ID NO: 61263
  derived and/or modified sequence opt1 from hemagglutinin__InfluenzaA__ABM22323

SEQ ID NO: 62525 - RNA, 1701 nt, Artificial Sequence; identical to SEQ ID NO: 61263
  derived and/or modified sequence opt1 from hemagglutinin__InfluenzaA__ABM22334

SEQ ID NO: 62526 - RNA, 1701 nt, Artificial Sequence; identical to SEQ ID NO: 61264
  derived and/or modified sequence opt1 from hemagglutinin__InfluenzaA__ABM22345

SEQ ID NO: 62527 - RNA, 1701 nt, Artificial Sequence; identical to SEQ ID NO: 61264
  derived and/or modified sequence opt1 from hemagglutinin__InfluenzaA__ABM22356

SEQ ID NO: 62528 - RNA, 1701 nt, Artificial Sequence; identical to SEQ ID NO: 61264
  derived and/or modified sequence opt1 from hemagglutinin__InfluenzaA__ABM22367

SEQ ID NO: 62529 - RNA, 1698 nt, Artificial Sequence; identical to SEQ ID NO: 61849
  derived and/or modified sequence opt1 from hemagglutinin__InfluenzaA__ABM66864

SEQ ID NO: 62530 - RNA, 1701 nt, Artificial Sequence; identical to SEQ ID NO: 61929
  derived and/or modified sequence opt1 from hemagglutinin__InfluenzaA__ABM66886

SEQ ID NO: 62531 - RNA, 1701 nt, Artificial Sequence; identical to SEQ ID NO: 61929
  derived and/or modified sequence opt1 from hemagglutinin__InfluenzaA__ABM66897

SEQ ID NO: 62532 - RNA, 1701 nt, Artificial Sequence; identical to SEQ ID NO: 61929
  derived and/or modified sequence opt1 from hemagglutinin__InfluenzaA__ABM66908

SEQ ID NO: 62533 - RNA, 1701 nt, Artificial Sequence; identical to SEQ ID NO: 61264
  derived and/or modified sequence opt1 from hemagglutinin__InfluenzaA__ABM66919

SEQ ID NO: 62534 - RNA, 1701 nt, Artificial Sequence; identical to SEQ ID NO: 61264
  derived and/or modified sequence opt1 from hemagglutinin__InfluenzaA__ABM66930

SEQ ID NO: 62535 - RNA, 1701 nt, Artificial Sequence; identical to SEQ ID NO: 61264
  derived and/or modified sequence opt1 from hemagglutinin__InfluenzaA__ABM66941

SEQ ID NO: 62536 - RNA, 1701 nt, Artificial Sequence; identical to SEQ ID NO: 61264
  derived and/or modified sequence opt1 from hemagglutinin__InfluenzaA__ABM66952

SEQ ID NO: 62537 - RNA, 1701 nt, Artificial Sequence; identical to SEQ ID NO: 61264
  derived and/or modified sequence opt1 from hemagglutinin__InfluenzaA__ABM66963

SEQ ID NO: 62538 - RNA, 1701 nt, Artificial Sequence; identical to SEQ ID NO: 61264
  derived and/or modified sequence opt1 from hemagglutinin__InfluenzaA__ABM66974

SEQ ID NO: 62539 - RNA, 1701 nt, Artificial Sequence; identical to SEQ ID NO: 61264
  derived and/or modified sequence opt1 from hemagglutinin__InfluenzaA__ABM66985

SEQ ID NO: 62540 - RNA, 1701 nt, Artificial Sequence; identical to SEQ ID NO: 61264
  derived and/or modified sequence opt1 from hemagglutinin__InfluenzaA__ABM66996

SEQ ID NO: 62541 - RNA, 1701 nt, Artificial Sequence; identical to SEQ ID NO: 61264
  derived and/or modified sequence opt1 from hemagglutinin__InfluenzaA__ABM67007

SEQ ID NO: 62542 - RNA, 1701 nt, Artificial Sequence; identical to SEQ ID NO: 61264
  derived and/or modified sequence opt1 from hemagglutinin__InfluenzaA__ABM67018

SEQ ID NO: 62543 - RNA, 1701 nt, Artificial Sequence
  derived and/or modified sequence opt1 from hemagglutinin__InfluenzaA__ABM67029
augaagaccaucaucgcccugagcuacaucaucugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcaagcgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccgacaacgaccagaucuuccucuacgcgcaggccagcgggcggaucaccguguccacgaagcgcagccagcagaccgugaucccgaacaucggcagccggccccgcguccgggacauccccucccgcaucagcaucuacuggaccaucgugaagcccggcgacauccugcugaucaacuccaccgggaaccucaucgccccgcggggcuacuuccgcauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccucaaguccacccaggcggccaucaaccagaucaacgggaagcugaaccgccugaucggcaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagcgcaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 62544 - RNA, 1698 nt, Artificial Sequence; identical to SEQ ID NO: 61307
  derived and/or modified sequence opt1 from hemagglutinin__InfluenzaA__ABM67051

SEQ ID NO: 62545 - RNA, 1707 nt, Artificial Sequence
  derived and/or modified sequence opt1 from hemagglutinin__InfluenzaA__ABM90467
auggagaagaucgugcugcuccugagcaucgucucccuggucaagagcgaccagaucugcaucggcuaccacgccaacaacuccaccgagcaggucgacaccaucauggagaagaacgugacggugacccacgcccaggacauccucgagaagacccacaacgggaagcugugcgaccuggacggcgugaagccccucauccugcgcgacugcagcguggcgggguggcugcucggcaacccgaugugcgacgaguucaucaacgugcccgagugguccuacaucguggagaaggccaaccccaccaacgaccugugcuaccccgggagcuucaacgacuacgaggagcugaagcaccuccugucccggaucaaccacuucgagaagauccagaucauccccaagagcuccuggagcgaccacgaggccuccagcggcgucuccagcgccugcccguaccugggcucccccagcuucuuccgcaacgugguguggcucaucaagaagaacuccacguaccccaccaucaagaaguccuacaacaacaccaaccaggaggaccugcugguccucugggggauccaccacccgaacaacgaggccgagcagacccggcuguaccagaaccccacgaccuacaucagcaucggcaccagcacccugaaccagcgccucgugcccaagaucgcgacgcggagcaaggugaacgggcaguccggccgcauggaguucuucuggaccauccugaagcccaacgacgccaucaacuucgagagcaacgggaacuucaucgccccggaguacgccuacaagaucgucaagaagggcgacuccgcgaucaugaaguccgagcuggaguacggcaacugcaacaccaagugccagacccccaugggggccaucaacagcagcaugcccuuccacaacauccacccccucacgaucggcgagugcccgaaguacgugaaguccaaccggcuggugcuggccaccgggcuccgcaacagcccccagcgggagucccgccggaagaagcgcggccuguucggcgccaucgccggguucaucgagggcggguggcagggcauggucgacgggugguacggcuaccaccacagcaacgagcagggcuccggguacgcggccgacaaggagagcacccagaaggccaucgacggcgugaccaacaaggugaacuccaucaucgacaagaugaacacgcaguucgaggccgucgggcgggaguucaacaaccuggagcgccggaucgagaaccucaacaagaagauggaggacggcuuccuggacguguggaccuacaacgccgagcugcucgugcugauggagaacgagcgcacccuggacuuccacgacagcaacgucaagaaccucuacgacaaggugcggcugcagcugcgcgacaacgcgaaggagcucgggaacggcugcuucgaguucuaccacaagugcgacaacgagugcauggaguccauccggaacggcaccuacaacuacccccaguacagcgaggaggcccgccugaagcgggaggagaucuccggggucaagcuggagagcaucggcacguaccagauccucuccaucuacagcaccguggccagcucccuggcccuggccaucaugaucgcggggcucagccuguggaugugcuccaacggcagccugcagugccgcaucugcaucuga

SEQ ID NO: 62546 - RNA, 1707 nt, Artificial Sequence
  derived and/or modified sequence opt1 from hemagglutinin__InfluenzaA__ABM90511
auggagaagaucgugcugcuccugagcaucgucucccuggucaagagcgaccagaucugcaucggcuaccacgccaacaacuccaccgagcaggucgacaccaucaucgagaagaacgugacggugacccacgcccaggacauccucgagaagacccacaacgggaagcugugcgaccuggacggcgugaagccccucauccugaaggacugcagcguggcgggguggcugcucggcaacccgaugugcgacgaguucaucaacgugcccgagugguccuacaucguggagaaggccaaccccaccaacgaccugugcuaccccgggagcuucaacgacuacgaggagcugaagcaccuccugucccgcaucaaccacuucgagaagauccagaucauccccaagagcuccuggagcgaccacgaggccuccagcggcgucuccagcgccugcccguaccugggcucccccagcuucuuccggaacgugguguggcucaucaagaagaacuccacguaccccaccaucaagaaguccuacaacaacaccaaccaggaggaccugcugguccucugggggauccaccacccgaacaacgaggaggagcagacccgccuguaccagaaccccacgaccuacaucagcaucggcaccagcacccugaaccagcggcucgugcccaagaucgccacgcgcagcaaggugaacgggcaguccggccggauggaguucuucuggaccauccugaagcccaacgacgcgaucaacuucgagagcaacgggaacuucaucgccccggaguacgccuacaagaucgucaagaagggcgacuccgccaucaugaaguccgagcuggaguacagcaacugcaacaccaagugccagacccccaugggcgcgaucaacagcuccaugcccuuccacaacauccacccccucacgaucggggagugcccgaaguacgucaagagcucccgccuggugcuggccaccggccuccggaacagcccccagcgcgagucccggcgcaagaagcgggggcuguucggcgccaucgccggcuucaucgagggcggguggcaggggaugguggacggcugguacggguaccaccacagcaacgagcagggcuccggcuacgccgcggacaaggagagcacccagaaggccaucgacggggugaccaacaaggugaacuccaucaucgacaagaugaacacgcaguucgaggccgucggccgcgaguucaacaaccuggagcggcgcaucgagaaccucaacaagaagauggaggacggguuccuggacguguggaccuacaacgccgagcugcucgugcugauggagaacgagcggacccuggacuuccacgacagcaacgucaagaaccucuacgacaaggugcgccugcagcugcgggacaacgccaaggagcucggcaacgggugcuucgaguucuaccacaagugcgacaacgagugcauggaguccauccgcaacggcaccuacaacuacccccaguacagcgaggaggcgcggcugaagcgcgaggagaucuccggcgucaagcuggagagcaucgggacguaccagauccucagcaucuacuccaccguggccagcucccuggcccuggccaucaugaucgccggccucagccuguggaugugcuccaacgggagccugcagugccggaucugcaucuga

SEQ ID NO: 62547 - RNA, 1707 nt, Artificial Sequence
  derived and/or modified sequence opt1 from hemagglutinin__InfluenzaA__ABM90533
auggagaagaucgugcugcuccugagcaucgucucccuggucaagagcgaccagaucugcaucggcuaccacgccaacaacuccaccgagcaggucgacaccaucauggagaagaacgugacggugacccacgcccaggacauccucgagaagacccacaacgggaagcugugcgaccuggacggcgugaagccccucauccugaaggacugcagcguggcgggguggcugcucggcaacccgaugugcgacgaguucaucaacgugcccgagugguccuacaucguggagaaggccaaccccaccaacgaccugugcuaccccgggagcuucaacgacuacgaggagcugaagcaccuccugucccgcaucaaccacuucgagaagauccagaucauccccaagagcuccuggagcgaccacgaggccuccagcggcgucuccagcgccugcccguaccugggcucccccagcuucuuccggaacgugguguggcucaucaagaagaacuccacguaccccaccaucaagaaguccuacaacaacaccaaccaggaggaccugcugguccucugggggauccaccacccgaacaacgaggaggagcagacccgccuguaccagaaccccacgaccuacaucagcaucggcaccagcacccugaaccagcggcucgugcccaagaucgccacgcgcagcaaggugaacgggcaguccggccggauggaguucuucuggaccauccugaagcccaacgacgcgaucaacuucgagagcaacgggaacuucaucgccccggaguacgccuacaagaucgucaagaagggcgacuccgccaucaugaaguccgagcuggaguacagcaacugcaacaccaagugccagacccccaugggcgcgaucaacagcuccaugcccuuccacaacauccacccccucacgaucggggagugcccgaaguacgucaagagcucccgccuggugcuggccaccggccuccggaacagcccccagcgcgagucccggcgcaagaagcgggggcuguucggcgccaucgccggcuucaucgagggcggguggcaggggaugguggacggcugguacggguaccaccacagcaacgagcagggcuccggcuacgccgcggacaaggagagcacccagaaggccaucgacggggugaccaacaaggugaacuccaucaucgacaagaugaacacgcaguucgaggccgucggccgcgaguucaacaaccuggagcggcgcaucgagaaccucaacaagaagauggaggacggguuccuggacguguggaccuacaacgccgagcugcucgugcugauggagaacgagcggacccuggacuuccacgacagcaacgucaagaaccucuacgacaaggugcgccugcagcugcgggacaacgccaaggagcucggcaacgggugcuucgaguucuaccacaagugcgacaacgagugcauggaguccauccgcaacggcaccuacaacuacccccaguacagcgaggaggcgcggcugaagcgcgaggagaucuccggcgucaagcuggagagcaucgggacguaccagauccucagcaucuacuccaccguggccagcucccuggcccuggccaucaugaucgccggccucagccuguggaugugcuccaacgggagccugcagugccggaucugcaucuga

SEQ ID NO: 62548 - RNA, 1707 nt, Artificial Sequence; identical to SEQ ID NO: 62547
  derived and/or modified sequence opt1 from hemagglutinin__InfluenzaA__ABM90544

SEQ ID NO: 62549 - RNA, 1701 nt, Artificial Sequence
  derived and/or modified sequence opt1 from hemagglutinin__InfluenzaA__ABN50900
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagagcuccuggccgaagcacaacgucacccggggcgugacggccagcugcucccacaagggcaagagcuccuucuaccgcaaccuccuguggcugaccgagaagaacgggagcuaccccaaccucagcaaguccuacgugaacaacaaggagaaggagguccuggugcuguggggcgugcaccaccccagcaacaucgaggaccagaagaccaucuaccggaaggagaacgccuacgucuccguggugagcucccacuacaaccgccgguucacccccgagaucgcgaagcgcccgaagguccgggggcaggagggccgcaucaacuacuacuggacgcuccuggagcccggcgacaccaucaucuucgaggccaacgggaaccugaucgcccccugguacgccuucgcccucagccggggcuucggguccggcaucaucaccagcaacgcguccauggacgagugcgacgccaagugccagacgccccagggcgccaucaacagcucccugccguuccagaacgugcaccccgugaccaucggggagugccccaaguacguccgcagcaccaagcugcggauggugaccggccuccgcaacauccccuccauccagagccgggggcuguucggcgccaucgccggguucaucgagggcggcuggaccgggaugaucgacggcugguacggguaccaccaccagaacgagcagggcuccggguacgcggccgaccagaaguccacgcagaacgccaucaacggcaucaccaacaaggugaacagcgucaucgagaagaugaacacccaguucaccgccgugggcaaggaguucaacaagcuggagaagcgcauggagaaccucaacaagaagguggacgacggguuccuggacaucuggacguacaacgccgagcugcucguccugcuggagaacgagcggacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuacccgaaguacagcgaggaguccaagcucaaccgcgagaagaucgacggggugaagcuggagagcaugggcgucuaccagauccuggccaucuacuccaccguggccagcucccucgugcugcuggucagccucggcgccaucuccuucuggaugugcagcaacgggucccugcagugccggaucugcaucuga

SEQ ID NO: 62550 - RNA, 1701 nt, Artificial Sequence; identical to SEQ ID NO: 61929
  derived and/or modified sequence opt1 from hemagglutinin__InfluenzaA__ABN50917

SEQ ID NO: 62551 - RNA, 1701 nt, Artificial Sequence
  derived and/or modified sequence opt1 from hemagglutinin__InfluenzaA__ABN50928
augaaggccaagcugcucauccugcugugcgccuucaccgcgaccgacgccgacacgaucugcaucggcuaccacgccaacaacagcaccgacaccguggacaccguccucgagaagaacgugacggugacccacuccgucaaccugcuggaggacagccacaacgggaagcucugccgccugaagggcaucgcgccccugcagcucgggaacugcuccaucgccggcuggauccuggggaacccggagugcgagagccuguucuccaagaaguccuggagcuacaucgccgagacccccaacagcgagaacgggaccugcuaccccggcuacuucgccgacuacgaggagcuccgggagcagcuguccagcguguccagcuucgagcgcuucgagaucuuccccaaggaguccagcuggccgaaccacacggugaccaagggcgucaccgccuccugcagccacaagggcaaguccagcuucuaccggaaccugcucuggcugaccgagaagaacggguccuaccccaaccugagcaagagcuacgugaacaacaaggagaaggaggugcucguccuguggggcgugcaccaccccuccaacaucggggaccagcgcgccaucuaccacacggagaacgcguacgugagcgucguguccagccacuacaaccggcgcuucacccccgagaucgccaagcggccgaaggugcgcggccaggagggccggaucaacuacuacuggacccugcucgagcccggggacaccaucaucuucgaggccaacggcaaccugaucgcccccugguacgccuucgcgcugucccgcggguucggcagcggcaucaucacguccaacgccagcauggacgagugcgacgccaagugccagacgccccagggggccaucaacuccagccucccguuccagaacguccaccccgugaccaucggcgagugccccaaguacgugcgguccaccaagcugcgcauggucaccgggcugcggaacauccccagcauccagucccgcggccucuucggggccaucgcgggcuucaucgagggcggguggaccggcaugaucgacgggugguacggcuaccaccaccagaacgagcaggggagcggcuacgccgccgaccagaaguccacccagaacgccaucaacggcaucaccaacaaggugaacagcgugaucgagaagaugaacacgcaguucaccgccgucgggaaggaguucaacaagcuggagcggcgcauggagaaccugaacaagaagguggacgacggcuuccucgacaucuggaccuacaacgcggagcugcuggugcuccuggagaacgagcggacccuggacuuccacgacuccaacgucaagaaccucuacgagaaggucaagagccagcugaagaacaacgccaaggagaucgggaacggcugcuucgaguucuaccacaagugcaacaacgagugcauggaguccgugaagaacgggacguacgacuacccgaaguacagcgaggagagcaagcugaaccgcgagaagaucgacggcgugaagcucgaguccaugggcguguaccagauccuggccaucuacagcaccgucgccuccagccuggugcuccuggugucccugggggccaucagcuucuggaugugcuccaacggcagccuccagugccggaucugcaucuga

SEQ ID NO: 62552 - RNA, 1701 nt, Artificial Sequence
  derived and/or modified sequence opt1 from hemagglutinin__InfluenzaA__ABN50940
augaaggccaagcugcucgugcugcugugcgccuucaccgcgaccgacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggagcuacaucgccgagacccccaacagcgagaacgggaccugcuaccccggcuacuucuccgacuacgaggagcuccgggagcagcugagcuccgugagcuccuucgagcgcuucgagaucuuccccaaggagagcuccuggccgaaccacacggucaccaagggggugaccgccagcugcucccacaagggcaagagcuccuucuaccggaaccugcucuggcugaccgagaagaacgggagcuaccccaaccugagcaaguccuacgugaacaacaaggagaaggagguccucgugcuguggggcgugcaccaccccagcaacaucggggaccagcgcgccaucuaccacacggagaacgccuacgucuccguggugagcucccacuacaaccggcgcuucacccccgagaucgcgaagcggccgaagguccgcgaccaggagggccggaucaacuacuacuggacccugcucgagcccgaggacaccaucaucuucgaggccaacggcaaccugaucgcccccugguacgccuucgcccugagccgcggguucggcuccgggaucaucacgagcaacgcguccauggacgagugcgacgccaagugccagacgccccagggcgccaucaacagcucccucccguuccagaacgugcaccccgugaccaucggcgagugccccaaguacguccggagcaccaagcugcgcauggugaccgggcugcggaacauccccuccauccagagccgcggccucuucggggccaucgccggcuucaucgagggcggcuggaccggcaugaucgacgggugguacggcuaccaccaccagaacgagcagggguccggcuacgcggccgaccagaaguccacccagaacgccaucaacgggaucaccaacaaggugaacagcgucaucgagaagaugaacacgcaguucaccgccgugggcaaggaguucaacaagcuggagcggcgcauggagaaccugaacaagaagguggacgacggcuuccucgacaucuggaccuacaacgccgagcugcugguccuccuggagaacgagcggacccuggacuuccacgacagcaacgugaagaaccucuacgagaaggucaagucccagcugaagaacaacgcgaaggagaucgggaacggcugcuucgaguucuaccacaagugcaacaacgagugcauggagagcgugaagaacgggacguacgacuacccgaaguacagcgaggaguccaagcugaaccgcgagaagaucgacggcgugaagcucgagagcaugggggucuaccagauccuggccaucuacuccaccguggccagcucccuggugcuccuggucagccugggcgccaucuccuucuggaugugcagcaacggcucccuccagugccggaucugcaucuga

SEQ ID NO: 62553 - RNA, 1701 nt, Artificial Sequence; identical to SEQ ID NO: 62519
  derived and/or modified sequence opt1 from hemagglutinin__InfluenzaA__ABN50951

SEQ ID NO: 62554 - RNA, 1701 nt, Artificial Sequence
  derived and/or modified sequence opt1 from hemagglutinin__InfluenzaA__ABN50962
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucagccggggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcgcagcacgaagcugcggauggugaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgcggagcugcucgugcugcuggagaacgagcgcacgcucgacuuccacgacagcaacgucaagaaccuguacgagaaggugaagaaccagcugaagaacaacgccaaggagaucgggaacggcugcuucgaguucuaccacaagugcaacaacgagugcauggaguccgugaagaacgggaccuacgacuaccccaaguacagcgaggaguccaagcucaagcgggagaagaucgacggcgucaagcuggagagcaugggcguguaccagauccuggccaucuacagcaccguggccuccagccucguccugcuggugucccucggggccaucagcuucuggaugugcuccaacggcagccugcagugccgcaucugcaucuga

SEQ ID NO: 62555 - RNA, 1701 nt, Artificial Sequence; identical to SEQ ID NO: 61918
  derived and/or modified sequence opt1 from hemagglutinin__InfluenzaA__ABN50973

SEQ ID NO: 62556 - RNA, 1701 nt, Artificial Sequence; identical to SEQ ID NO: 61263
  derived and/or modified sequence opt1 from hemagglutinin__InfluenzaA__ABN50984

SEQ ID NO: 62557 - RNA, 1701 nt, Artificial Sequence; identical to SEQ ID NO: 61264
  derived and/or modified sequence opt1 from hemagglutinin__InfluenzaA__ABN50995

SEQ ID NO: 62558 - RNA, 1701 nt, Artificial Sequence
  derived and/or modified sequence opt1 from hemagglutinin__InfluenzaA__ABN51043
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccgggacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggccugccagaaggggaacauccggugcaacaucugcaucuga

SEQ ID NO: 62559 - RNA, 1701 nt, Artificial Sequence; identical to SEQ ID NO: 62404
  derived and/or modified sequence opt1 from hemagglutinin__InfluenzaA__ABN51054

SEQ ID NO: 62560 - RNA, 1701 nt, Artificial Sequence
  derived and/or modified sequence opt1 from hemagglutinin__InfluenzaA__ABN51066
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaagaaguccagcuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcggaccaucuaccacaccgagaacgccuacgugagcguggucuccagccacuacucccgccgguucaccccggagaucgcgaagcgccccaaggugcgggaccaggagggccgcaucaacuacuacuggacgcuccuggagcccggcgacaccaucaucuucgaggccaacgggaaccugaucgcccccugguacgccuucgcccucagccggggcuucggguccggcaucaucaccagcaacgcguccaugggcgacugcgacgccaagugccagaccccgcagggggccaucaacagcucccugcccuuccagaacgugcaccccgucacgaucggcgagugccccaaguacgugcgcagcaccaagcugcggauggugaccgggcuccgcaacaucccguccauccagagccggggccuguucggggccaucgccggcuucaucgagggcggguggaccggcaugaucgacgggugguacggcuaccaccaccagaacgagcagggguccggcuacgcggccgacaagaaguccacgcagaacgccaucgacggcaucaccaacaaggucaacagcgugaucgagaagaugaacacccaguucaccgccguggggaaggaguucaacaagcuggagcgccggauggagaaccucaacaagaaggucgacgacggcuuccuggacaucuggacguacaacgccgagcugcucgugcugcuggagaacgagcgcacccucgacuuccacgacagcaacgucaagaaccuguacgagaaggugaagaaccagcugaagaacaacgcgaaggagaucgggaacggcugcuucgaguucuaccacaagugcaacaacgagugcaucgaguccgugaagaacgggaccuacgacuaccccaaguacagcgaggaguccaagcucaagcgggagaagaucgacggcgucaagcuggagagcaugggcguguaccagauccuggccaucuacagcaccguggccuccagccucguccugcuggugucccucggggccaucggcuucuggaugugcagcaacgggucccugcagugccgcaucugcaucuga

SEQ ID NO: 62561 - RNA, 1698 nt, Artificial Sequence; identical to SEQ ID NO: 61304
  derived and/or modified sequence opt1 from hemagglutinin__InfluenzaA__ABN51077

SEQ ID NO: 62562 - RNA, 1698 nt, Artificial Sequence; identical to SEQ ID NO: 61307
  derived and/or modified sequence opt1 from hemagglutinin__InfluenzaA__ABN51088

SEQ ID NO: 62563 - RNA, 1701 nt, Artificial Sequence
  derived and/or modified sequence opt1 from hemagglutinin__InfluenzaA__ABN51099
augaagaccaucaucgcccugagcuacaucuucugccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagaugaacgagaaguuccaccagaucgagaaggaguucagcgagguggagggccgcauccaggaccuggagaaguacguggaggacacgaagaucgaccugugguccuacaacgcggagcuccuggucgcccuggagaaccagcacaccaucgaccucaccgacagcgagaugaacaagcuguucgagaagacccggcgccagcugcgggagaacgccgaggacauggggaacggcugcuucaagaucuaccacaagugcgacaacgccugcaucgaguccauccgcaacggcacguacgaccacgacguguaccgcgacgaggcccucaacaaccgguuccagaucaagggggucgagcucaagagcggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 62564 - RNA, 1701 nt, Artificial Sequence
  derived and/or modified sequence opt1 from hemagglutinin__InfluenzaA__ABN51110
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucaacugcacccugaucgacgcccuccugggcgacccccacugcgacgucuuccaggacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagagcggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 62565 - RNA, 1701 nt, Artificial Sequence
  derived and/or modified sequence opt1 from hemagglutinin__InfluenzaA__ABN51121
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucaacugcacccugaucgacgcccuccugggcgacccccacugcgacgucuuccaggacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgucaacaagaucaccuacgggaccugccccaaguacgugaagcagaacacgcugaagcucgccaccggcaugcgcaacgugcccgagaagcagacccggggccuguucggcgccaucgccggguucaucgagaacggcugggaggggaugaucgacggcugguacggcuuccgccaccagaacagcgaggggaccggccaggcggccgaccugaaguccacgcaggccgccaucgaccagaucaacgggaagcucaaccgggucaucgagaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacaccaucgaccucacggaccuggagaugaacaagcuguucgagaagacccggcgccagcuccgggagaacgccgaggacauggggaacggcugcuucaagaucuaccacaagugcgacaacgccugcaucgagagcauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggcgugccagcgcggcaacauccggugcaacaucugcaucuga

SEQ ID NO: 62566 - RNA, 1701 nt, Artificial Sequence
  derived and/or modified sequence opt1 from hemagglutinin__InfluenzaA__ABN51132
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucaacugcacccugaucgacgcccuccugggcgacccccacugcgacgucuuccaggacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgccagcaucgacacgugcaucuccgagugcaucacccccaacgggagcauccccaacgacaagcccuuccagaacgucaacaagaucaccuacggcgccugcccgaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucgagagcauccgcaacggcaccuacgaccacgacguguaccgcgacgaggcccucaacaaccgguuccagaucaagggggucgagcugaaguccggcuacaaggacuggauccuguggaucagcuucgcgaucuccugcuuccuccugugcguggugcugcucggguucaucaugugggccugccagcgcggcaacauccggugcaacaucugcaucuga

SEQ ID NO: 62567 - RNA, 1698 nt, Artificial Sequence; identical to SEQ ID NO: 61808
  derived and/or modified sequence opt1 from hemagglutinin__InfluenzaA__ABN51143

SEQ ID NO: 62568 - RNA, 1701 nt, Artificial Sequence
  derived and/or modified sequence opt1 from hemagglutinin__InfluenzaA__ABN51154
augaagaccaucaucgcccugagcuacauccucugccugguguucacccagaagcugcccggcaacgacaacuccacggccacccucugccuggggcaccacgcggucccgaacggcacccuggugaagaccaucacgaacgaccagaucgaggugaccaacgccaccgagcucguccagagcuccagcaccgggcgcaucugcgacagcccccaccagauccuggacggcgagaacugcacgcugaucgacgcccuccugggggacccccacugcgacggcuuccagaacaaggagugggaccuguucguggagcggagcaaggccuacuccaacugcuaccccuacgacgugccggacuacgucagccuccgcucccugguggccagcuccggcacccuggaguucaacaacgagagcuucaacuggaccgggguggcgcagaacggcaccuccagcgccugcaagcggcgcuccgacaagagcuucuucucccggcucaacuggcugcaccagcugaaguacaaguaccccgcccucaacgucacgaugcccaacaacgagaaguucgacaagcuguacaucuggggcgugcaccaccccgggaccgacagcgaccagaucucccuguacgcccaggcgagcgggcgcgugaccgucagcaccaagcggucccagcagacggugaucccgaacaucggcagcggccccugggugcgcggggucuccagccggaucuccaucuacuggaccaucgugaagcccggcgacauccuccugaucaacagcaccgggaaccugaucgcgccccgcggcuacuucaagauccgguccggcaagagcuccaucaugcgcagcgacgccccgaucgggaagugcaacuccgagugcaucacccccaacggcagcauccccaacgacaagcccuuccagaacgugaaccggaucacguacgggccgugcccccgcuacgucaagcagaacacccucaagcuggccaccggcaugcggaacgugcccgagaagcagacccgcgggaucuucggcgccaucgccggcuucaucgagaacgggugggagggcaugauggacgggugguacggcuuccggcaccagaacuccgaggggacgggccaggccgccgaccugaaguccacccaggccgccaucaaccagaucaacggcaagcucaaccgccugaucgagaagaccaacgagaaguuccaccagaucgagaaggaguucuccgagguggaggggcggauccaggaccuggagaaguacgucgaggacaccaagaucgaccucuggagcuacaacgcggagcugcugguggcccucgagaaccagcacacgaucgaccugaccgacuccgagaugaacaagcuguucgagcgcaccaagaagcagcuccgggagaacgccgaggacaugggcaacgggugcuucaagaucuaccacaagugcgacaacgccugcaucggcagcauccgcaacgggaccuacgaccacgacguguaccgcgacgaggcccugaacaaccgguuccagaucaagggcgucgagcugaaguccggcuacaaggacuggauccucuggaucagcuucgcgaucagcugcuuccugcugugcaucgugcuccugggguucaucaugugggccugccagaagggcaacauccgcugcaacaucugcaucuga

SEQ ID NO: 62569 - RNA, 1701 nt, Artificial Sequence
  derived and/or modified sequence opt1 from hemagglutinin__InfluenzaA__ABN59390
augaagaccaucaucgcccugagcuacaucaucugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcaagcgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccgacaacgaccagaucuuccucuacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcugaucaacuccaccgggaaccucaucgccccgcggggcuacuuccgcauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccucaaguccacccaggcggccaucaaccagaucaacgggaagcugaaccgccugaucggcaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagcgcaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 62570 - RNA, 1701 nt, Artificial Sequence
  derived and/or modified sequence opt1 from hemagglutinin__InfluenzaA__ABN59401
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcaacaucgccggcuggauccuggggaacccggagugcgagagccucuucuccaagaaguccuggagcuacaucgccgagacccccaacagcgagaacgggaccugcuaccccggcuacuucgccgacuacgaggagcugcgggagcagcuguccagcguguccagcuucgagcgcuucgagaucuuccccaaggagcgguccuggccgaagcacaacaucacccgcggcgucacggccgccugcagccacaagggcaaguccagcuucuaccggaaccuccuguggcugaccgagaagaacggguccuaccccaaccucaacaagagcuacgugaacaacaaggagaaggaggugcugguccuguggggcgugcaccaccccuccaacaucgaggaccagaagacccucuaccgcaaggagaacgcguacgugagcgucgugagcuccaacuacaaccggcgcuucacccccgagaucgccgagcggccgaaggugcgcgggcaggccggccggaucaacuacuacuggacgcugcuggagcccggcgacaccaucaucuucgaggccaacgggaaccucaucgcccccuggcacgcguucgcccugagccgcggcuucggguccggcaucaucaccagcaacgccuccauggacgagugcgacaccaagugccagacgccccagggcgccaucaacagcucccugccguuccagaacauccaccccgucaccaucggggagugccccaaguacgugcggagcaccaagcuccgcauggugaccggccugcggaacauccccuccauccagagccgcgggcuguucggcgccaucgcgggguucaucgagggcggcuggacggggaugaucgacggcugguacggguaccaccaccagaacgagcagggcuccggguacgccgccgaccagaaguccacccagaacgccaucaacggcaucaccaacaaggucaacagcgugaucgagaagaugaacacccaguucacggccgugggcaaggaguucaacaagcucgagaagcggauggagaaccugaacaagaaggucgacgacggguuccuggacaucuggaccuacaacgcggagcuccuggugcugcucgagaacgagcgcacccuggacuuccacgacagcaacgugaagaaccuguacgagaaggucaagucccagcucaagaacaacgccaaggagaucggcaacgggugcuucgaguucuaccacaagugcaacaacgagugcauggagagcgugaagaacggcaccuacgacuacccgaaguacuccgaggagagcaagcugaaccgggagaagaucgacggggucaagcuggaguccaugggcguguaccagauccucgccaucuacagcacgguggccagcucccugguccugcucgugagccugggcgccaucuccuucuggaugugcagcaacgggucccugcagugccgcaucugcaucuga

SEQ ID NO: 62571 - RNA, 1698 nt, Artificial Sequence
  derived and/or modified sequence opt1 from hemagglutinin__InfluenzaA__ABN59412
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcugaagaacagcuacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggaguuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 62572 - RNA, 1701 nt, Artificial Sequence
  derived and/or modified sequence opt1 from hemagglutinin__InfluenzaA__ABN59423
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagcggagcuggccgaagcacaacgucacccgcggggugacggccuccugcagccacaagggcaaguccagcuucuaccggaaccuccuguggcugaccgagaagaacggguccuaccccaaccucagcaagagcuacgugaacaacaaggagaaggagguccuggugcuguggggcgugcaccaccccuccaacaucgagaaccagaagaccaucuaccgcaaggagaacgccuacgucagcgugguguccagcaacuacaaccggcgcuucacccccgagaucgcggagcggccgaagguccgcgaccaggaggggcggaucaacuacuacuggacgcuccuggagcccggcgacaccaucaucuucgaggccaacggcaaccugaucgcccccugguacgccuucgcccucucccgcggguucggcagcgggaucaucaccuccaacgcgagcauggacgagugcgacaccaagugccagacgccccagggcgccaucaacuccagccugccguuccagaacgugcaccccgugaccaucggcgagugccccaaguacguccgguccaccaagcugcgcauggugaccgggcuccggaacauccccagcauccagucccgcggccuguucggggccaucgccggcuucaucgagggcggcuggacgggcaugaucgacgggugguacggcuaccaccaccagaacgagcaggggagcggcuacgccgcggaccagaaguccacccagaacgccaucaacgggaucaccaacaaggugaacagcgucaucgagaagaugaacacccaguucacggccgugggcaaggaguucaacaagcuggagaagcggauggagaaccucaacaagaagguggacgacggcuuccuggacaucuggaccuacaacgccgagcugcucguccugcuggagaacgagcgcacccucgacuuccacgacuccaacgugaagaaccuguacgagaaggucaagagccagcugaagaacaacgccaaggagaucgggaacggcugcuucgaguucuaccacaagugcaacaacgagugcauggaguccgugaagaacgggaccuacgacuacccgaaguacagcgaggagagcaagcucaaccgggagaagaucgacggcgugaagcuggaguccaugggggucuaccagauccuggcgaucuacagcacgguggccuccagccucgugcugcuggucucccucggcgccaucagcuucuggaugugcuccaacggcagccugcagugccgcaucugcaucuga

SEQ ID NO: 62573 - RNA, 1701 nt, Artificial Sequence; identical to SEQ ID NO: 61774
  derived and/or modified sequence opt1 from hemagglutinin__InfluenzaA__ABO32656

SEQ ID NO: 62574 - RNA, 1701 nt, Artificial Sequence
  derived and/or modified sequence opt1 from hemagglutinin__InfluenzaA__ABO32667
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccagcgggcgggugaccguguccaccaagcgcagccagcagaccgucaucccgaacaucggcucccggcccugggugcgcgacgugagcucccggaucagcaucuacuggacgaucgucaagcccggcgacauccuccugaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacagcgaggggaccggccaggccgcggaccugaaguccacgcaggccgccaucaaccagaucaacgggaagcucaaccgccugaucggcaagaccaacgagaaguuccaccagaucgagaaggaguucagcgagguggagggccggauccaggaccuggagaaguacgucgaggacaccaagaucgaccucugguccuacaacgccgagcugcugguggcccucgagaaccagcacaccaucgaccugacggacagcgagaugaacaagcuguucgagcgcaccaagaagcagcuccgggagaacgcggaggacauggggaacggcugcuucaagaucuaccacaagugcgacaacgccugcaucggguccauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcgugguccuccugggcuucaucaugugggccugccagaaggggaacauccgcugcaacaucugcaucuga

SEQ ID NO: 62575 - RNA, 1698 nt, Artificial Sequence
  derived and/or modified sequence opt1 from hemagglutinin__InfluenzaA__ABO32678
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucagcaagcuggagcggcgcauggagaaccuccacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacggucgccuccagccucgugcugcuggugucccucggggccaucagcuucuggaugugcuccaacggcagccugcagugccggaucugcaucuga

SEQ ID NO: 62576 - RNA, 1701 nt, Artificial Sequence
  derived and/or modified sequence opt1 from hemagglutinin__InfluenzaA__ABO32692
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcgugguccugcucggguucaucaugugggccugccagaagggcaacauccggugcaacaucugcaucuga

SEQ ID NO: 62577 - RNA, 1701 nt, Artificial Sequence; identical to SEQ ID NO: 62441
  derived and/or modified sequence opt1 from hemagglutinin__InfluenzaA__ABO32751

SEQ ID NO: 62578 - RNA, 1701 nt, Artificial Sequence; identical to SEQ ID NO: 62441
  derived and/or modified sequence opt1 from hemagglutinin__InfluenzaA__ABO32762

SEQ ID NO: 62579 - RNA, 1701 nt, Artificial Sequence; identical to SEQ ID NO: 62463
  derived and/or modified sequence opt1 from hemagglutinin__InfluenzaA__ABO32775

SEQ ID NO: 62580 - RNA, 1701 nt, Artificial Sequence; identical to SEQ ID NO: 61251
  derived and/or modified sequence opt1 from hemagglutinin__InfluenzaA__ABO32790

SEQ ID NO: 62581 - RNA, 1701 nt, Artificial Sequence
  derived and/or modified sequence opt1 from hemagglutinin__InfluenzaA__ABO32803
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgucagccugcggucccucguggcgagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucagccuguacgcccaggcguccggccggaucaccgugagcacgaagcgcagccagcagaccgucaucccgaacaucggcucccggccccgcgugcgggacauccccagccgcaucuccaucuacuggaccaucgugaagcccggggacacccugcucaucaacagcacgggcaaccugaucgccccgcggggguacuucaagauccgcuccggcaagagcuccaucaugcggagcgacgcccccaucgacaagugcaacuccgagugcaucacccccaacggcagcauccccaacgacaagccguuccagaacgucaaccgcaucaccuacggggccugcccccgguacgugaagcagaacacccugaagcucgccacgggcaugcgcaacgugcccgagaagcagacccgggggaucuucggcgcgaucgccggguucaucgagaacggcugggagggcauggucgacgggugguacggcuuccgccaccagaacuccgaggggaucggccaggccgccgaccugaaguccacccaggccgcgaucaaccagaucaacgggaagcugaaccggcucaucggcaagaccaacgagaaguuccaccagaucgagaaggaguucuccgagguggagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgccugcaucgggagcauccgcaacggcacguacgaccacgacguguaccgggacgaggcgcucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 62582 - RNA, 1701 nt, Artificial Sequence; identical to SEQ ID NO: 61641
  derived and/or modified sequence opt1 from hemagglutinin__InfluenzaA__ABO32816

SEQ ID NO: 62583 - RNA, 1701 nt, Artificial Sequence; identical to SEQ ID NO: 61264
  derived and/or modified sequence opt1 from hemagglutinin__InfluenzaA__ABO32827

SEQ ID NO: 62584 - RNA, 1701 nt, Artificial Sequence
  derived and/or modified sequence opt1 from hemagglutinin__InfluenzaA__ABO32838
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagcgcugggaccuguucguggagcggagcaaggccuacuccaacugcuaccccuacgacgugccggacuacgcgagccugcgcucccucgucgccagcuccgggacgcuggaguucaacaacgagagcuucaacuggaccggcgugacccagaacgggaccuccagcgccugcaagcggcgcuccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccgcaucaccguguccacgaagcggagccagcagaccgugaucccgaacaucggcagccgcccccggguccgcaacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacagcgagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 62585 - RNA, 1701 nt, Artificial Sequence; identical to SEQ ID NO: 62584
  derived and/or modified sequence opt1 from hemagglutinin__InfluenzaA__ABO32849

SEQ ID NO: 62586 - RNA, 1701 nt, Artificial Sequence
  derived and/or modified sequence opt1 from hemagglutinin__InfluenzaA__ABO32860
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagcgcugggaccuguucguggagcggagcaaggccuacuccaacugcuaccccuacgacgugccggacuacgcgagccugcgcucccucgucgccagcuccgggacgcuggaguucaacaacgagagcuucaacuggaccggcgugacccagaacgggaccuccagcgccugcaagcggcgcuccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccgcaucaccguguccacgaagcggagccagcagaccgugaucccgaacaucggcagccgcccccggguccgcgacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacagcgagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 62587 - RNA, 1701 nt, Artificial Sequence; identical to SEQ ID NO: 62569
  derived and/or modified sequence opt1 from hemagglutinin__InfluenzaA__ABO32871

SEQ ID NO: 62588 - RNA, 1701 nt, Artificial Sequence
  derived and/or modified sequence opt1 from hemagglutinin__InfluenzaA__ABO32882
augaagaccaucaucgcccugagcuacaucaucugccucguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaagugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcaagcgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccgacaacgaccagaucuucccguacgcgcaggccagcgggcggaucaccguguccacgaagcgcagccagcagaccgugauccccaacaucggcagccggccccgcguccggaacauccccucccgcaucagcaucuacuggaccaucgugaagccgggcgacauccuccugaucaacuccaccgggaaccugaucgcgccccggggcuacuuccgcauccggagcgggaaguccagcaucaugcgcuccgacgcccccaucggcaagugcaacagcgagugcaucacgcccaacggcuccaucccgaacgacaagcccuuccagaacgugaaccggaucaccuacggggccugcccccgcuacgucaagcagaacacccucaagcuggccaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucaaccagaucaacgggaagcucaaccgccugaucggcaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagcgcaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 62589 - RNA, 1701 nt, Artificial Sequence
  derived and/or modified sequence opt1 from hemagglutinin__InfluenzaA__ABO32893
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggccugccagaaggggaacauccggugcaacaucugcaucuga

SEQ ID NO: 62590 - RNA, 1701 nt, Artificial Sequence; identical to SEQ ID NO: 62589
  derived and/or modified sequence opt1 from hemagglutinin__InfluenzaA__ABO32904

SEQ ID NO: 62591 - RNA, 1701 nt, Artificial Sequence; identical to SEQ ID NO: 62404
  derived and/or modified sequence opt1 from hemagglutinin__InfluenzaA__ABO32915

SEQ ID NO: 62592 - RNA, 1701 nt, Artificial Sequence; identical to SEQ ID NO: 62404
  derived and/or modified sequence opt1 from hemagglutinin__InfluenzaA__ABO32926

SEQ ID NO: 62593 - RNA, 1701 nt, Artificial Sequence
  derived and/or modified sequence opt1 from hemagglutinin__InfluenzaA__ABO32937
augaagaccaucaucgcccugagcuacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacgcuggaguucaacaacgagagcuucaacuggaccggggugacccagaacggcaccuccagcuccugcaagcggcgcagcaacaacuccuucuucagccggcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcccaggcguccgggcgcaucaccgugagcacgaagcggagccagcagaccgugaucccgaacaucggcucccgcccccggguccgcaacauccccagccggaucuccaucuacuggaccaucgugaagcccggcgacauccugcucaucaacagcaccgggaaccugaucgccccgcgcggcuacuucaagauccgguccgggaaguccuccaucaugcgcagcgacgcccccaucggcaagugcaacuccgagugcaucacgcccaacggcagcauccccaacgacaagccguuccagaacgugaaccggaucaccuacggggccugcccccgcuacgucaagcagaacacccugaagcucgccaccggcaugcggaacgugcccgagaagcagacgcgcgggaucuucggcgcgaucgccggguucaucgagaacggcugggagggcaugguggacgggugguacggcuuccggcaccagaacuccgaggggaucggccaggccgccgaccucaagagcacccaggccgcgaucaaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgcgagaacgccgaggacauggggaacggcugcuucaagaucuaccacaagugcgacaacgccugcaucgggagcauccggaacggcaccuacgaccacgacgucuaccgcgacgaggcgcucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 62594 - RNA, 1698 nt, Artificial Sequence
  derived and/or modified sequence opt1 from hemagglutinin__InfluenzaA__ABO32948
augcgcgccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgggagcagcucuccagcguguccagcuucgagcgcuucgagaucuucccgaagggguccagcuggcccaaccacaccgugaccggcgucuccgccagcugcucccacaacggcaagagcuccuucuaccggaaccugcuguggcucaccgggaagaacgggcuguaccccaaccugagcauguccuacgugaacaacaaggagaaggaggugcucguccuguggggcgugcaccacccgcccaacaucggcgaccagcgcgcccuguaccacacggagaacgccuacgugagcgucgugagcucccacuacagccggcgcuucacccccgagaucgccaagcggcccaaggugcgcgaccaggaggggcggaucaacuacuacuggacccuccuggagcccggcgacaccaucaucuucgaggcgaacgggaaccugaucgccccgugguacgccuucgcccucucccgcggcuucggcagcgggaucaucacguccaacgcccccauggacgagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 62595 - RNA, 1698 nt, Artificial Sequence
  derived and/or modified sequence opt1 from hemagglutinin__InfluenzaA__ABO32959
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagccgguccuacgugaacaacaaggagaaggaggugcucguccuguggggcgugcaccacccgcccaacaucggggaccagcgcgcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacacccugaucuucgaggcgaacggcaaccucaucgccccgugguacgccuucgcccugucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcaccaagcuccgcauggucaccgggcugcggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcucgagcggcgcauggagaaccugaacaagaaggucgacgacggcuuccuggacaucuggaccuacaacgccgagcuccuggugcugcucgagaacgagcggacccuggacuuccacgacagcaacgugaagaaccuguacgagaaggucaagucccagcucaagaacaacgccaaggagaucgggaacggcugcuucgaguucuaccacaagugcaacaacgagugcauggagagcgugaagaacgggacguacgacuaccccaaguacuccgaggagagcaagcugaaccgcgagaagaucgacggcgugaagcuggaguccaugggcgucuaccagauccucgcgaucuacagcaccguggccagcucccuggugcugcucgucagccugggggccaucuccuucuggaugugcagcaacggcucccugcagugccggaucugcaucuga

SEQ ID NO: 62596 - RNA, 1698 nt, Artificial Sequence; identical to SEQ ID NO: 62212
  derived and/or modified sequence opt1 from hemagglutinin__InfluenzaA__ABO32970

SEQ ID NO: 62597 - RNA, 1701 nt, Artificial Sequence
  derived and/or modified sequence opt1 from hemagglutinin__InfluenzaA__ABO32981
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagcggagcuggccgaagcacaacgucacccgcggggugacggccuccugcagccacaagggcaaguccagcuucuaccggaaccuccuguggcugaccgagaagaacggguccuaccccaaccucagcaagagcuacgugaacaacaaggagaaggagguccuggugcuguggggcgugcaccaccccuccaacaucaaggaccagaagaccaucuaccgcaaggagaacgccuacgucagcgugguguccagcaacuacaaccggcgcuucacccccgagaucgcggagcggccgaagguccgcgaccaggccgggcggaucaacuacuacuggacgcuccuggagcccggcgacaccaucaucuucgaggccaacggcaaccugaucgcccccugguacgccuucgcgcucucccgcggguucggcagcgggaucaucaccuccaacgccagcauggacgagugcgacaccaagugccagacgccccagggcgccaucaacuccagccugccguuccagaacgugcaccccgugaccaucggcgagugccccaaguacguccgguccaccaagcugcgcauggugaccgggcuccggaacauccccagcauccagucccgcggccuguucggggccaucgccggcuucaucgagggcggcuggacgggcaugaucgacgggugguacggcuaccaccaccagaacgagcaggggagcggcuacgcggccgaccagaaguccacccagaacgccaucaacgggaucaccaacaaggugaacagcgucaucgagaagaugaacacccaguucacggccgugggcaaggaguucaacaagcuggagaagcggauggagaaccucaacaagaagguggacgacggcuuccuggacaucuggaccuacaacgccgagcugcucguccugcuggagaacgagcgcacccucgacuuccacgacuccaacgugaagaaccuguacgagaaggucaagagccagcugaagaacaacgcgaaggagaucgggaacggcugcuucgaguucuaccacaagugcaacaacgagugcauggaguccgugaagaacgggaccuacgacuacccgaaguacagcgaggagagcaagcucaaccgggagaagaucgacggcgugaagcuggaguccaugggggucuaccagauccuggccaucuacagcacgguggccuccagccucgugcugcuggucucccucggcgccaucagcuucuggaugugcuccaacggcagccugcagugccgcaucugcaucuga

SEQ ID NO: 62598 - RNA, 1701 nt, Artificial Sequence
  derived and/or modified sequence opt1 from hemagglutinin__InfluenzaA__ABO32992
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagcggagcuggccgaagcacgacgucacccgcggggugacggccuccugcagccacaagggcaaguccagcuucuaccggaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccgcaaggagaacgccuacgucagcgugguguccagcaacuacaaccggcgcuucacccccgagaucuccgagcggccgaagguccgcgaccagaaggggcggaucaacuacuacuggacgcuccuggagcccggcgacaccaucaucuucgaggcgaacggcaaccugaucgcccccugguacgccuucgcccucagccgcggguucggcuccgggaucaucaccagcaacgccuccauggacgagugcgacaccaagugccagacgccccagggcgcgaucaacagcucccugccguuccagaacgugcaccccgugaccaucggcgagugccccaaguacguccggagcaccaagcugcgcauggugaccgggcuccggaacauccccuccauccagagccgcggccuguucggggccaucgccggcuucaucgagggcggcuggacgggcaugaucgacgggugguacggcuaccaccaccagaacgagcagggguccggcuacgccgccgaccagaaguccacccagaacgcgaucaacgggaucaccaacaaggugaacagcgucaucgagaagaugaacacccaguucacggccgugggcaaggaguucaacaagcuggagaagcggauggagaaccucaacaagaagguggacgacggcuuccuggacaucuggaccuacaacgccgagcugcucguccugcuggagaacgagcgcacccucgacuuccacgacagcaacgugaagaaccuguacgagaaggucaagucccagcugaagaacaacgccaaggagaucgggaacggcugcuucgaguucuaccacaagugcaacaacgagugcauggagagcgugaagaacgggaccuacgacuacccgaaguacagcgaggaguccaagcucaaccgggagaagaucgacggcgugaagcuggagagcaugggggucuaccagauccuggccaucuacuccacgguggcgagcucccucgugcugcuggucagccucggcgccaucuccuucuggaugugcagcaacggcucccugcagugccgcaucugcaucuga

SEQ ID NO: 62599 - RNA, 1701 nt, Artificial Sequence
  derived and/or modified sequence opt1 from hemagglutinin__InfluenzaA__ABO33006
augaaggccaagauccuggugcuccugugcgcccugagcgcgaccgacgccgacaccaucugcaucggcuaccacgccaacaacuccacggacaccgucgacaccgugcucgagaagaacgugaccgucacgcacagcgugaaccugcuggaggacucccacaacgggaagcucugccgccugaagggcaucgcgccccugcagcucgggaagugcagcaucgccggcuggauccuggggaacccggagugcgagucccuguucagcaagaaguccuggagcuacaucgccgagacccccaacuccgagaacgggaccugcuaccccggcuacuucgccgacuacgaggagcuccgggagcagcugagcuccgugagcuccuucgagcgcuucgagaucuuccccaaggagcggagcuggccgaagcacaacgucacccgcggggugacggccuccugcagccacaagggcaaguccagcuucuaccggaaccugcucuggcugaccgagaagaacggguccuaccccaaccugagcaagagcuacgugaacaacaaggagaaggagguccucgugcuguggggcgugcaccaccccuccaacaucgaggaccagaagaccaucuaccgcaaggagaacgccuacgucagcgugguguccagcaacuacaaccggcgcuucacccccgagaucuccaagcggccgaagguccgcgaccaggaggggcggaucaacuacuacuggacgcugcucgagcccggcgacaccaucaucuucgaggcgaacggcaaccugaucgcccccugguacgccuucgcccugagccgcggguucggcuccgggaucaucaccagcaacgccuccauggacgagugcgacaccaagugccagacgccccagggcgcgaucaacagcucccucccguuccagaacgugcaccccgugaccaucggcgagugccccaaguacguccggagcaccaagcugcgcauggugaccgggcugcggaacauccccuccauccagagccgcggccucuucggggccaucgccggcuucaucgagggcggcuggacgggcaugaucgacgggugguacggcuaccaccaccagaacgagcagggguccggcuacgccgccgaccagaaguccacccagaacgcgaucaacgggaucaccaacaaggugaacagcgucaucgagaagaugaacacccaguucacggccgugggcaaggaguucaacaagcuggagaagcggauggagaaccugaacaagaagguggacgacggcuuccucgacaucuggaccuacaacgccgagcugcugguccuccuggagaacgagcgcacccuggacuuccacgacagcaacgugaagaaccucuacgagaaggucaagucccagcugaagaacaacgccaaggagaucgggaacggcugcuucgaguucuaccacaagugcaacaacgagugcauggagagcgugaagaacgggaccuacgacuacccgaaguacagcgaggaguccaagcugaaccgggagaagaucgacggcgugaagcucgagagcaugggggucuaccagauccuggccaucuacuccacgguggcgagcucccuggugcuccuggucagccugggcgccaucuccuucuggaugugcagcaacggcucccuccagugccgcaucugcaucuga

SEQ ID NO: 62600 - RNA, 1701 nt, Artificial Sequence
  derived and/or modified sequence opt1 from hemagglutinin__InfluenzaA__ABO33025
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggagcuacaucgccgagacccccaacagcgagaacgggaccugcuaccccggcuacuucgccgacuacgaggagcugcgcgagcagcuguccagcguguccagcuucgagcgguucgagaucuuccccaaggaguccagcuggccgaaccacaacgucaccaagggggugacggccuccugcagccacaagggcaaguccagcuucuaccgcaaccuccuguggcugaccgagaagaacggguccuaccccaaccucagcaagagcuacgugaacaacaaggagaaggagguccuggugcuguggggcgugcaccaccccuccaacaucaaggaccagcggaccaucuaccgcaaggagaacgccuacgucagcgugguguccagccacuacaaccggcgcuucacccccgagaucgcgaagcggccgaagguccgcgaccaggaggggcggaucaacuacuacuggacgcuccuggagcccggcgacaccaucaucuucgaggccaacggcaaccugaucgcccccugguacgccuucgcccucucccgcggguucggcagcgggaucaucaccuccaacgcgagcauggacgagugcgacgccaagugccagacgccccagggcgccaucaacuccagccugccguuccagaacgugcaccccgugaccaucggcgagugccccaaguacguccgguccaccaagcugcgcauggugaccgggcuccggaacauccccagcauccagucccgcggccuguucggggccaucgccggcuucaucgagggcggcuggaccggcaugaucgacgggugguacggcuaccaccaccagaacgagcaggggagcggcuacgcggccgaccagaaguccacgcagagcgccaucaacgggaucaccaacaaggugaacuccaucaucgagaagaugaacacccaguucaccgccgucggcaaggaguucaacaagcuggagaagcggauggagaaccucaacaagaagguggacgacggcuuccuggacaucuggacguacaacgccgagcugcucgugcugcuggagaacgagcgcacccucgacuuccacgacagcaacgucaagaaccuguacgagaaggugaagucccagcugaagaacaacgcgaaggagaucgggaacggcugcuucgaguucuaccacaagugcaacaacgagugcauggagagcgucaagaacgggaccuacgacuacccgaaguacagcgaggaguccaagcucaaccgggagaagaucgacggcgugaagcuggagagcauggggguguaccagauccuggccaucuacuccaccgucgccagcucccucgugcugcuggugagccucggcgccaucuccuucuggaugugcagcaacggcucccugcagugccgcaucugcaucuga

SEQ ID NO: 62601 - RNA, 1701 nt, Artificial Sequence
  derived and/or modified sequence opt1 from hemagglutinin__InfluenzaA__ABO33036
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcaacagcccccaccagauccuggacggcgagaacugcacccugaucgacgcccuccugggggacccccacugcgacggcuuccagaacaaggagugggaccuguucguggagcggcgcaaggccuacagcaacugcuaccccuacgacgugccggacuacgcgucccuccggagccuggucgccuccagcggcacgcuggaguucaacaacgaguccuucaacuggaccgggguggcccagaacggcaccagcuccgccugcaagcgccggagcaucaaguccuucuucagccgccucaacuggcugcaccagcugaaguacaaguaccccgcgcucaacgugaccaugcccaacaacgagaaguucgacaagcuguacaucuggggcguccaccaccccuccacggacagcgaccagaucucccuguacgcccaggccagcgggcgggugaccgugagcaccaagcgcucccagcagaccgucaucccgaacaucgggagccggcccugggugcgcggcguguccagccggaucuccaucuacuggacgaucgucaagcccggcgacauccuccugaucaacagcaccgggaaccugaucgcgccccgcggcuacuucaagauccgguccgggaaguccuccaucaugcgcagcgacgccccgaucggcaagugcaacuccgagugcaucacccccaacggcagcauccccaacgacaagcccuuccagaacgugaaccggaucaccuacggggccugcccgcgcuacgugaagcagaacacgcucaagcuggccaccggcaugcggaacguccccgagaagcagacccgcgggaucuucggcgccaucgccggguucaucgagaacggcugggagggcaugguggacgggugguacggcuuccggcaccagaacuccgaggggaccggccaggccgcggaccucaagagcacgcaggccgccaucaaccagaucaacgggaagcugaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgguuccagaucaagggcgucgagcugaaguccggguacaaggacuggauccucuggaucagcuucgccaucagcugcuuccugcugugcgugguccuccugggcuucaucaugugggccugccagaagggcaacauccgcugcaacaucugcaucuga

SEQ ID NO: 62602 - RNA, 1701 nt, Artificial Sequence; identical to SEQ ID NO: 61080
  derived and/or modified sequence opt1 from hemagglutinin__InfluenzaA__ABO33047

SEQ ID NO: 62603 - RNA, 1701 nt, Artificial Sequence; identical to SEQ ID NO: 61658
  derived and/or modified sequence opt1 from hemagglutinin__InfluenzaA__ABO33058

SEQ ID NO: 62604 - RNA, 1701 nt, Artificial Sequence
  derived and/or modified sequence opt1 from hemagglutinin__InfluenzaA__ABO33069
augaagaccaucaucgcccugagcuacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuucuccaacugcuaccccuacgacgugccggacuacgcgagccugcggucccucgucgccagcuccggcacgcuggaguucaucaacgagggguucaacuggaccggcgugacccagaacgggggcagcuacgccugcaagcgcgggcccgacaacuccuucuucagccggcugaacuggcucuacgaguccgagagcaaguaccccgugcugaacgucaccaugcccaacaacgacaacuucgacaagcuguacaucuggggcgugcaccacccguccacggacaaggagcagaccaaccucuacgugcaggccagcggccgcgucaccguguccaccaagaagucccagcagacgaucauccccaacguggggagccggcccuggguccgcggccuguccagccggaucuccaucuacuggaccaucgugaagcccggggacauccugcucaucaacagcaacggcaaccugaucgcgccgcgcggcuacuucaagauccggaccgggaaguccagcaucaugcgcuccgacgcccccaucgggaccugcagcuccgagugcaucacgcccaacggcagcauccccaacgacaagccguuccagaacgugaacaagaucaccuacggcgccugccccaaguacgucaagcagaacacccugaagcucgccaccgggaugcggaacgugcccgagaagcagacgcgcggcaucuucggcgccaucgcgggguucaucgagaacggcugggaggggaugguggacggcugguacggguuccggcaccagaacuccgagggcaccggccaggccgccgaccucaagagcacccaggccgccaucgaccagaucaacgggaagcugaaccgcgucaucgagaagaccaacgagaaguuccaccagaucgagaaggaguucuccgagguggagggccggauccaggaccucgagaaguacaucgaggacacgaagaucgaccuguggagcuacaacgcggagcugcucguggcccuggagaaccagcacaccaucgaccugaccgacuccaagaugaacaagcuguucgagaagacccgccggcagcugcgcgagaacgccgaggacauggggaacggcugcuucaagaucuaccacaagugcgacaacgccugcaucgggagcauccggaacggcacguacgaccacgacgucuaccgcgacgaggcccugaacaaccgcuuccagaucaagggcguggagcucaaguccggguacaaggacuggauccuguggaucagcuucgcgaucuccugcuuccugcucugcgucgugcugcugggcuucaucaugugggccugccagaaggggaacauccggugcaacaucugcaucuga

SEQ ID NO: 62605 - RNA, 1701 nt, Artificial Sequence; identical to SEQ ID NO: 61929
  derived and/or modified sequence opt1 from hemagglutinin__InfluenzaA__ABO37988

SEQ ID NO: 62606 - RNA, 1701 nt, Artificial Sequence
  derived and/or modified sequence opt1 from hemagglutinin__InfluenzaA__ABO38010
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcuccgggagcagcugagcuccgucagcuccuucgagcgcuucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgggccaucuaccacaccgagaacgcguacgugagcguggucuccagccacuacucccgccgguucaccccggagaucgccaagcgccccaaggugcgggaccaggagggccgcaucaacuacuacuggacccuccuggagcccggcgacacgaucaucuucgaggccaacgggaaccugaucgcccccugguacgccuucgcgcucagccggggcgugggguccggcaucaucaccagcaacgccuccaugggcgacugcgacgccaagugccagaccccgcagggggccaucaacagcucccugcccuuccagaacguccaccccgugaccaucggcgagugccccaaguacgugcgcagcacgaagcugcggauggucaccgggcuccgcaacaucccguccauccagagccggggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggugaacagcgugaucgagaagaugaacacccaguucaccgccgucgggaaggaguucaacaagcuggagcgccggauggagaaccucaacaagaagguggacgacggcuuccuggacaucuggaccuacaacgcggagcugcucguccugcuggagaacgagcgcacgcucgacuuccacgacagcaacgugaagaaccuguacgagaaggugaagaaccagcugaagaacaacgccaaggagaucgggaacggcugcuucgaguucuaccacaagugcaacaacgagugcauggaguccgucaagaacgggaccuacgacuaccccaaguacagcgaggaguccaagcucaagcgggagaagaucgacggcgugaagcuggagagcaugggcguguaccagauccuggccaucuacagcaccgucgccuccagccucgugcugcuggugucccucggggccaucagcuucuggaugugcuccaacggcagccugcagugccgcaucugcaucuga

SEQ ID NO: 62607 - RNA, 1698 nt, Artificial Sequence
  derived and/or modified sequence opt1 from hemagglutinin__InfluenzaA__ABO38021
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugauccccaaggagagcugguccuacaucgucgagacccccaaccccgagaacggcacgugcuacccgggcuacuucgccgacuacgaggagcugcgcgagcagcucagcuccgugagcuccuucgagcgguucgagaucuuccccaaggagagcuccuggcccaaccacaccgugaccggggucagcgccuccugcagccacaacggcaaguccagcuucuaccgcaaccugcuguggcucaccgggaagaacggccuguaccccaaccuguccaagagcuacgccaacaacaaggagaaggaggugcucgugcuguggggcguccaccacccgcccaacaucggggaccagcgggcccuguaccacacggagaacgccuacguguccguggucagcagccacuacucccgccgguucauccccgagauggcgaagcgccccaaggugcgggaccaggagggccgcaucaacuacuacuggacccuccuggagccgggggacaccaucaucuucgaggccaacggcaaccugaucgcccccugguacgccuucgcccucagccggggguucggcuccggcaucaucaccagcaacgcgcccaugggggagugcgacgccaagugccagacgccccagggcgccaucaacuccagccugccguuccagaacgugcaccccgucaccaucggggagugccccaaguacgugcgcuccgccaagcugcggauggugaccggccuccgcaacauccccagcauccagucccgggggcuguucggcgccaucgcgggcuucaucgagggcggguggaccgggauggucgacggcugguacggguaccaccaccagaacgagcagggcagcggcuacgccgccgaccagaaguccacgcagaacgccaucaacgggaucaccaacaaggugaacagcgugaucgagaagaugaacacccaguucaccgccgucggcaaggaguucaacaagcuggagcgccggauggagaaccucaacaagaagguggacgacggguuccuggacaucuggacguacaacgcggagcugcucguccugcuggagaacgagcgcacccucgacuuccacgacuccaacgugaagaaccuguacgagaaggucaagagccagcugaagaacaacgccaaggagaucggcaacgggugcuucgaguucuaccacaagugcaacaacgagugcauggaguccgugaagaacggcaccuacgacuacccgaaguacagcgaggaguccaagcucaaccgggagaagaucgacggcgugaagcuggagagcauggggguguaccagauccuggccaucuacuccaccgucgccagcagccucgugcugcuggugucccucggcgccaucagcuucuggaugugcuccaacgggagccugcagugccgcaucugcaucuga

SEQ ID NO: 62608 - RNA, 1698 nt, Artificial Sequence
  derived and/or modified sequence opt1 from hemagglutinin__InfluenzaA__ABO38032
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccgaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacccccaagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggacgggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgcgagaagaucgacggcgugaagcuggaguccaugggcaucuaccagauccuggccaucuacagcacggucgccagcucccucgugcugcuggugagccucggggccaucuccuucuggaugugcagcaacggcucccugcagugccggaucugcaucuga

SEQ ID NO: 62609 - RNA, 1698 nt, Artificial Sequence; identical to SEQ ID NO: 61808
  derived and/or modified sequence opt1 from hemagglutinin__InfluenzaA__ABO38043

SEQ ID NO: 62610 - RNA, 1701 nt, Artificial Sequence
  derived and/or modified sequence opt1 from hemagglutinin__InfluenzaA__ABO38054
augaaggcccgccugcucgugcugcugugcgcccucgcggccaccgacgccgacaccaucugcaucggcuaccacgccaacaacagcacggacaccgucgacaccgugcuggagaagaacgugaccgucacgcacuccgugaaccugcucgaggacagccacaacgggaagcugugccggcugaagggcaucgcgccccuccagcuggggaagugcaacaucgccggcuggauccuggggaacccggagugcgagucccuccugagcgagcgcuccuggagcuacaucguggagacccccaacuccgagaacgggaccugcuaccccggcgacuucaucgacuacgaggagcugcgggagcagcucagcuccgucagcuccuucgagcgcuucgagaucuucagcaaggaguccagcuggcccaagcacaacaccacgcgcggggugaccgccgccugcucccacgccggcaagagcuccuucuaccggaaccugcuguggcucaccgagaaggacgggagcuacccgaaccugaacaacuccuacgugaacaagaagggcaaggagguccuggugcucuggggcgugcaccaccccagcaacaucaaggaccagcagacccuguaccagaaggagaacgcguacgucagcgugguguccagcaacuacaaccggcgcuucacgcccgagaucgccgagcggcccaagguccgcggccaggccggccggaugaacuacuacuggacccugcucaagccgggggacaccaucauguucgaggccaacggcaaccugaucgcccccugguacgcguucgcccugucccgcggguucggcagcggcaucaucaccuccaacgccagcaugcacgagugcgacacgaagugccagacgccccagggggccaucaacuccagccuccccuuccagaacauccacccggugaccaucggcgagugccccaaguacgugcgguccaccaagcugcgcauggucaccgggcugcggaacauccccagcauccagucccgcggccucuucggggccaucgcgggcuucaucgagggcggguggaccggcaugaucgacgggugguacggcuaccaccaccagaacgagcaggggagcggcuacgccgccgaccagaaguccacccagaacgccaucaacggcaucaccaacaaggugaacagcgugaucgagaagaugaacacgcaguucaccgccgucgggaaggaguucaacaaccuggagaagcggauggagaaccugaacaagaagguggacgacggcuuccucgacaucuggaccuacaacgcggagcugcuggugcuccuggagaacgagcgcacccuggacuuccacgacuccaacgucaagaaccucuacgagaaggugaagaaccagcugcggaacaacgccaaggagaucgggaacggcugcuucgaguucuaccacaagugcaacaacgagugcauggagagcgucaagaacgggacguacgacuaccccaaguacuccgaggagagcaagcugaaccgcgagaagaucgacggcgugaagcucgaguccaugggcguguaccagauccuggccaucuacagcaccgucgccagcucccuggugcuccuggugagccugggggccaucuccuucuggaugugcagcaacggcucccuccagugccggaucugcaucuga

SEQ ID NO: 62611 - RNA, 1701 nt, Artificial Sequence
  derived and/or modified sequence opt1 from hemagglutinin__InfluenzaA__ABO38065
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagcggagcuggccgaagcacaacaucacccgcggcgucacggccuccugcagccacaagggcaaguccagcuucuaccggaaccuccuguggcugaccgagaagaacggguccuaccccaaccucagcaagagcuacgugaacaacaaggagaaggaggugcugguccuguggggcgugcaccaccccuccaacaucgaggaccagaagaccaucuaccgcaaggagaacgccuacgugagcgucguguccagcaacuacaaccggcgcuucacccccgagaucgcgaagcggccgaaggugcgcgggcaggagggccggaucaacuacuacuggacgcuccuggagcccggcgacaccaucaucuucgaggccaacgggaaccugaucgcccccugguacgccuucgcccucucccgcggcuucgggagcggcaucaucaccuccaacgcgagcauggacgagugcgacaccaagugccagacgccccagggcgccaucaacuccagccugccguuccagaacguccaccccgugaccaucggggagugccccaaguacgugcgguccaccaagcugcgcauggucaccggccuccggaacauccccagcauccagucccgcgggcuguucggcgccaucgccggguucaucgagggcggcuggacggggaugaucgacggcugguacggguaccaccaccagaacgagcagggcagcggguacgccgcggaccagaaguccacccagaacgccaucaacggcaucaccaacaaggugaacagcgugaucgagaagaugaacacccaguucacggccgucggcaaggaguucaacaagcuggagaagcggauggagaaccucaacaagaagguggacgacggguuccuggacaucuggaccuacaacgccgagcugcucgugcugcuggagaacgagcgcacccucgacuuccacgacuccaacgucaagaaccuguacgagaaggucaagagccagcugaagaacaacgccaaggagaucggcaacgggugcuucgaguucuaccacaagugcaacaacgagugcauggaguccgugaagaacggcaccuacgacuacccgaaguacagcgaggagagcaagcucaaccgggagaagaucgacggggugaagcuggaguccaugggcguguaccagauccuggcgaucuacagcacggucgccuccagccucgugcugcuggugucccucggcgccaucagcuucuggaugugcuccaacgggagccugcagugccgcaucugcaucuga

SEQ ID NO: 62612 - RNA, 1701 nt, Artificial Sequence; identical to SEQ ID NO: 61251
  derived and/or modified sequence opt1 from hemagglutinin__InfluenzaA__ABO38076

SEQ ID NO: 62613 - RNA, 1701 nt, Artificial Sequence
  derived and/or modified sequence opt1 from hemagglutinin__InfluenzaA__ABO38087
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcagcggcaaguccagcaucaugcgguccaacgccccgaucgggaagugcaacagcgagugcaucacccccaacggcuccauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggucgaggggcgcauccaggaccuggagaaguacguggaggacaccaagaucgaccucugguccuacaacgccgagcugcugguggcccucgagaaccagcacacgaucgaccugaccgacagcgagaugaacaagcuguucgagcggacccgcaagcagcuccgcgagaacgcggaggacgucggcaacggcugcuucaagaucuaccacaagugcgacaacgccugcaucggguccauccggaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcguggugcuccugggguucaucaugugggccugccagaagggcaacauccgcugcaacaucugcaucuga

SEQ ID NO: 62614 - RNA, 1689 nt, Artificial Sequence
  derived and/or modified sequence opt1 from hemagglutinin__InfluenzaA__ABO38098
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgacaucgccacgcggcccaaggugaacggccagggcgggcgcauggaguucagcuggacccuccuggacaugugggacaccaucaacuucgaguccaccggcaaccugaucgcccccgaguacggguucaagaucagcaagcggggcuccagcgggaucaugaagacggagggcacccucggcaacugcgagaccaagugccagaccccgcugggggccaucaacacgacccugcccuuccacaacgugcacccccucaccaucggcgagugccccaaguacgucaagagcgagaagcuggugcuggcgaccgggcuccgcaacgugccgcagaucgagucccggggccuguucggggccaucgccggcuucaucgagggcggguggcagggcauggucgacgggugguacggcuaccaccacagcaacgaccagggguccggcuacgccgccgacaaggagagcacgcagaaggcguucgacggcaucaccaacaaggugaacuccgugaucgagaagaugaacacccaguucgaggccgucgggaaggaguucagcaaccuggagcgccggcucgagaaccugaacaagaagauggaggacggcuuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucgggaacggcugcuucgaguucuaccacaagugcgacgacgagugcaugaacagcgugaagaacggcaccuacgacuaccccaaguacgaggaggaguccaagcugaaccggaacgagaucaagggggugaagcugagcuccaugggcgucuaccagauccucgccaucuacgccaccguggcggggagccugucccuggccaucaugauggccggcaucagcuucuggaugugcuccaacgggagccuccagugccgcaucugcaucuga

SEQ ID NO: 62615 - RNA, 1701 nt, Artificial Sequence
  derived and/or modified sequence opt1 from hemagglutinin__InfluenzaA__ABO38230
augaagaccaucaucgcccugagcuacaucuucugccagguguucgcccagaaccuccccggcaacgacaacuccaccgcgacgcugugccuggggcaccacgccgucccgaacggcacccucgugaagaccaucaccaacgaccagaucgaggugacgaacgccaccgagcugguccagagcuccagcaccgggcgcaucugcgacaacccccaccggauccuggacggcaagaacugcacccucaucgacgcccugcugggggacccccacugcgacggcuuccagaacgagaagugggaccucuucguggagcgcuccaaggccuucagcaacugcuaccccuacgacgugccggacuacgcgucccugcggagccuggucgccuccagcggcacgcucgaguucuucaacgagggguucaacuggaccggcgugacccagaacgggggcuccuacgccugcaagcgcgggcccgacaacagcuucuucucccggcugaacuggcuguacaagagcgaguccaccuaccccgugcucaacgucacgaugcccaacaacgacaacuucgacaagcuguacaucuggggcgugcaccacccgagcaccgacaaggagcagaccaaccuguacgugcaggccuccggccgcgucaccgugagcacgaagcggucccagcagaccaucauccccagcguggggagccgccccuggguccggggccucuccagccgcaucuccaucuacuggaccaucgugaagcccggggacgugcugcugaucaacagcaacggcaaccucaucgcgccgcggggcuacuucaagauccgcaccgggaaguccagcaucaugcgguccgacgcccccaucggcacgugcagcuccgagugcaucacccccaacgggagcauccccaacgacaagccguuccagaacgucgacaagaucaccuacggcgccugccccaaguacgugaagcagaacacccugaagcuggccacggggaugcgcaacgugcccgagaagcagacccggggcaucuucggcgccaucgcgggguucaucgagaacggcugggaggggaugaucgacggcugguacggguuccgccaccagaacuccgagggcaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccuggagaaguacguggaggacaccaagaucgaccucuggagcuacaacgcggagcugcuggucgcccucgagaaccagcacaccaucgaccugaccgacuccgagaugaacaagcuguucgagaagacgcggcgccagcuccgggagaacgccgaggacauggggaacggcugcuucaagaucuaccacaagugcgacaacgccugcaucgggagcauccgcaacggcaccuacgaccacgacguguaccgcgacgaggcccugaacaaccgguuccagaucaagggcgucgagcugaaguccggguacaaggacuggauccucuggaucagcuucgcgaucuccugcuuccugcugugcguggugcuccugggcuucaucaugugggccugccagaaggggaacauccgcugcaacaucugcaucuga

SEQ ID NO: 62616 - RNA, 1701 nt, Artificial Sequence
  derived and/or modified sequence opt1 from hemagglutinin__InfluenzaA__ABO38241
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcaagaacugcacccugaucgacgcccugcucggggacccccacugcgacggcuuccagaacgagaagugggaccuguucguggagcgcuccaaggccuucagcaacugcuaccccuacgacgugccggacuacgcgucccugcggagccucgucgccuccagcggcacgcuggaguucaucaacgagggguucaacuggaccggcgugacccaguccgggggcagcuacacgugcaagcgcggguccgugaacagcuucuucucccggcugaacuggcucuacgagagcgaguccaaguaccccgcccugaacgucaccaugcccaacaacggcaaguucgacaagcuguacaucuggggcgugcaccaccccagcaccgacaaggagcagaccaaccucuacgugcgcgccagcgggcgggucaccguguccacgaagcgcagccagcagaccgugaucccgaacaucggcccccggcccuggguccgcgggcuguccagccggaucuccaucuacuggaccaucgugaagcccggcgacauccugcucaucaacagcaccggcaaccugaucgcgccgcgcggguacuucaagauccggacgggcaaguccagcaucaugcgcuccgacgcccccaucgggaccugcagcuccggcugcaucacccccaacgggagcauccccaacgacaagccguuccagaacgugaacaagaucaccuacggcgccugcccccgguacgucaagcagaacacgcugaagcucgccaccggcaugcgcaacgugcccgagaagcagacccgggggaucuucggcgccaucgcgggguucaucgagaacggcugggaggggaugguggacggcugguacggcuuccgccaccagaacuccgaggggaccggccaggccgccgaccucaagagcacgcaggccgccaucgaccagaucaacgggaagcugaaccggcucaucgagaagaccaacgagaaguuccaccagaucgagaaggaguucuccgaggucgagggccgcauccaggaccuggagaaguacguggaggacaccaagaucgaccuguggagcuacaacgcggagcuccugguggcccuggagaaccagcacaccaucgacaugacggacuccgagaugaacaagcuguucgagaagacccggaagcagcugcgcgagaacgccgaggacauggggaacggcugcuucaagaucuaccacaagugcgacaacgccugcaucggcagcauccgcaacgggaccuacgaccacgacgucuaccgggacgaggcccugaacaaccgcuuccagaucaagggcguggagcucaaguccggguacaaggacuggauccuguggaucagcuucgcgaucagcugcuuccugcucugcgucgugcugcugggcuucaucaugugggccugccagaagggcaacauccggugcaacaucugcaucuga

SEQ ID NO: 62617 - RNA, 1701 nt, Artificial Sequence; identical to SEQ ID NO: 61290
  derived and/or modified sequence opt1 from hemagglutinin__InfluenzaA__ABO38252

SEQ ID NO: 62618 - RNA, 1689 nt, Artificial Sequence
  derived and/or modified sequence opt1 from hemagglutinin__InfluenzaA__ABO38296
auggugaucaucuaccugauccuccuguucaccgccguccgcggcgaccagaucugcaucggguaccacgccaacaacagcaccgagaagguggacacgauccuggagcggaacgugaccgucacccacgcgaaggacauccucgagaagacccacaacggcaagcugugcaagcugaacgggaucccgccccucgagcugggcgacugcuccaucgccggguggcugcucggcaaccccgagugcgaccgccugcugagcgugcccgagugguccuacaucauggagaaggagaacccccgggacggccucugcuacccggggagcuucaacgacuacgaggagcugaagcacuuccuguccagcgugaagcacuucgagaaggucaagauccuccccaaggaccgcuggacgcagcacaccaccaccggcgggucccgggccugcgccgugagcggcaaccccuccuucuuccgcaacaugguguggcugacgaagaaggggagcaacuaccccgucgccaagggcuccuacaacaacaccagcggcgagcagaugcugaucaucuggggcgugcaccacccgaacgacgagaccgagcagcggacccucuaccagaacguggggacguacgucuccguggggaccagcacccugaacaagcgcuccacccccgacaucgcgacgcggcccaaggugaacggccugggcgggcgcauggaguucagcuggacccuccuggacaugugggacaccaucaacuucgaguccaccggcaaccugaucgcccccgaguacggguucaagaucagcaagcggggcuccagcgggaucaugaagacggagggcacccucggcaacugcgagaccaagugccagaccccgcugggggccaucaacacgacccugcccuuccacaacguccacccccucaccaucggcgagugccccaaguacgucaagagcgagaagcuggugcuggccaccgggcuccgcaacgugccgcagaucgagucccggggccuguucggggcgaucgccggcuucaucgagggcggguggcagggcaugguggacgggugguacggcuaccaccacagcaacgaccagggguccggcuacgccgccgacaaggagagcacgcagaaggccuucgacggcaucaccaacaaggugaacuccgucaucgagaagaugaacacccaguucgaggcgguggggaaggaguucagcaaccuggagcgccggcucgagaaccugaacaagaagauggaggacggcuuccuggacguguggaccuacaacgccgagcuccugguccugauggagaacgagcgcacgcucgacuuccacgacuccaacgugaagaaccuguacgacaagguccggaugcagcugcgcgacaacgccaaggagcucgggaacggcugcuucgaguucuaccacaagugcgacgacgagugcaugaacagcgugaagaacggcaccuacuacuaccccaaguacgaggaggaguccaagcugaaccggaacgagaucaagggggugaagcugagcuccaugggcgucuaccagauccucgccaucuacgccaccguggcggggagccugucccuggccaucaugauggccggcaucagcuucuggaugugcuccaacgggagccuccagugccgcaucugcaucuga

SEQ ID NO: 62619 - RNA, 1698 nt, Artificial Sequence; identical to SEQ ID NO: 61878
  derived and/or modified sequence opt1 from hemagglutinin__InfluenzaA__ABO38318

SEQ ID NO: 62620 - RNA, 1698 nt, Artificial Sequence; identical to SEQ ID NO: 61808
  derived and/or modified sequence opt1 from hemagglutinin__InfluenzaA__ABO38329

SEQ ID NO: 62621 - RNA, 1701 nt, Artificial Sequence
  derived and/or modified sequence opt1 from hemagglutinin__InfluenzaA__ABO38351
augaaggcccgccugcucgugcugcugugcgcccucgcggccaccgacgccgacaccaucugcaucggcuaccacgccaacaacagcacggacaccgucgacaccgugcuggagaagaacgugaccgucacgcacuccgugaaccugcucgaggacagccacaacgggaagcugugccggcugaagggcaucgcgccccuccagcuggggaagugcaacaucgccggcuggcugcucgggaacccggagugcgacccccugcugcccgcccgcuccuggagcuacaucguggagacccccaacuccgagaacggcaucugcuacccgggcgccuucaucgacuacgaggagcuccgggagcagcugagcuccgucagcuccuucgagcgcuucgagaucuuccccaaggagagcuccuggcccaaccacaacaccaacaucggggugaccgccgcgugcagccacgccggcaaguccagcuucuaccggaaccugcucuggcugacgaagaagggcggguccuaccccaagcugaagaacagcuacgugaacaagaaggggaaggagguccucgugcuguggggcauccaccacccguccaacagcaaggaccagcagacccuguaccagaacgagaacgccuacguguccgucgugagcagcaacuacaaccgccgguucacccccgagaucgccgagcgccccgaggugcgggaccaggccggccgcaugaacuacuacuggacccuccuggagcccggggacacgaucauguucgaggcgaacggcaaccuggucgccccgugguacgccuucgcccucucccggggguucggcagcggcaucaucaccuccaacgccagcaugcacgagugcaacaccaagugccagacgccccagggggcgaucaacuccagccugcccuuccagaacauccaccccgugaccaucggcgagugcccgaaguacgugcgcuccgccaagcugcggauggucaccgggcuccgcaacauccccagcauccagucccggggccuguucggggccaucgccggcuucaucgagggcggguggaccggcaugaucgacgggugguacggcuaccaccaccagaacgagcaggggagcggcuacgccgcggaccagaaguccacccagaacgccaucaacggcaucacgaacaaggugaacagcgugaucgagaagaugaacacccaguucaccgccgucgggaaggaguucaacaaccuggagaagcgcauggagaaccucaacaagaagguggacgacggcuuccuggacaucuggaccuacaacgccgagcugcucgugcugcuggagaacgagcggacgcucgacuuccacgacuccaacgucaagaaccuguacgagaaggucaagagccagcugaagaacaacgccaaggagaucgggaacggcugcuucgaguucuaccacaagugcgacaacgagugcauggaguccgugcgcaacgggaccuacgacuaccccaaguacagcgaggaguccaagcucaaccgggagaagaucgacggcgugaagcuggagagcaugggcguguaccagauccuggcgaucuacuccaccgucgccagcagccucgugcugcuggugucccucggggccaucagcuucuggaugugcuccaacggcagccugcagugccgcaucugcaucuga

SEQ ID NO: 62622 - RNA, 1701 nt, Artificial Sequence
  derived and/or modified sequence opt1 from hemagglutinin__InfluenzaA__ABO38362
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucgugagcaagaaguccuggagcuacaucgccgagacccccaacuccgagaacgggaccugcuaccccggcuacuucgccgacuacgaggagcugcgggagcagcugagcuccgucagcuccuucgagcgcuucgagaucuuccccaaggagagcuccuggccgaagcacaacgugacccgcggggugacggccagcugcucccacaagggcaagagcuccuucuaccggaaccuccuguggcugaccgagaagaacgggagcuaccccaaccucagcaaguccuacgucaacaacaaggagaaggaggugcuggugcuguggggcguccaccaccccagcaacaucgagaaccagaagaccaucuaccggaaggagaacgccuacguguccguggucagcucccacuacaaccgccgguucacccccgagaucgcgaagcgcccgaaggugcgggaccaggaggggcgcaucaacuacuacuggacgcuccuggagcccggcgacaccaucaucuucgaggccaacggcaaccugaucgcccccugguacgccuucgcccucagccggggguucggcuccgggaucaucaccagcaacgcguccaucgacgagugcgacgccaagugccagacgccccagggcgccaucaacagcucccugccguuccagaacgugcaccccgucaccaucggcgagugccccaaguacgugcgcagcaccaagcugcggauggugaccgggcuccgcaacauccccuccauccagagccggggccuguucggggccaucgccggcuucaucgagggcggcuggaccggcaugaucgacgggugguacggcuaccaccaccagaacgagcagggguccggcuacgcggccgaccagaaguccacgcagaacgccaucaacgggaucaccaacaaggucaacagcgugaucgagaagaugaacacccaguucaccgccgugggcaaggaguucaacaagcuggagaagcgcauggagaaccucaacaagaaggucgacgacggcuuccuggacaucuggacguacaacgccgagcugcucgugcugcuggagaacgagcggacccucgacuuccacgacagcaacgucaagaaccuguacgagaaggugaagucccagcugaagaacaacgcgaaggagaucgggaacggcugcuucgaguucuaccacaagugcaacaacgagugcauggagagcgugaagaacgggaccuacgacuacccgaaguacagcgaggaguccaagcucaaccgcgagaagaucgacggcgucaagcuggagagcauggggguguaccagauccuggccaucuacuccaccguggccagcucccucguccugcuggugagccucggcgccaucuccuucuggaugugcagcaacggcucccugcagugccggaucugcaucuga

SEQ ID NO: 62623 - RNA, 1698 nt, Artificial Sequence
  derived and/or modified sequence opt1 from hemagglutinin__InfluenzaA__ABO38373
augaaggcccgccugcucgugcugcugugcgcccucgcggccaccgacgccgacaccaucugcaucggcuaccacgccaacaacagcacggacaccgucgacaccgugcuggagaagaacgugaccgucacgcacuccgugaaccugcucgaggacagccacaacgggaagcugugccggcugaagggcaucgcgccccuccagcuggggaagugcaacaucgccggcuggauccuggggaacccggagugcgagucccuccugagcgagcgcuccuggagcuacaucguggagacccccaacuccgagaacgggaccugcuaccccggcgacuucaucgacuacgaggagcugcgggagcagcucagcuccgucagcuccuucgagcgcuucgagaucuucagcaaggaguccagcuggcccaagcacaccaccgggggcgugaccgccgccugcucccacgccggcaagagcuccuucuaccggaaccugcuguggcucaccgagaaggacggcagcuacccgaaccugaacaacuccuacgugaacaagaaggggaaggagguccuggugcucuggggcgugcaccaccccagcaacaucaaggaccagcagacccuguaccagaaggagaacgcguacgucagcgugguguccagcaacuacaaccgccgguucacgcccgagaucgccgagcgccccaagguccggggccaggccgggcgcaucaacuacuacuggacccugcucaagccgggcgacaccaucauguucgaggccaacgggaaccugaucgcccccugguacgcguucgcccugucccggggcuucggcagcgggaucaucaccuccaacgccagcaugcacgagugcgacacgaagugccagacgccccagggcgccaucaacuccagccuccccuuccagaacauccacccggugaccaucggggagugccccaaguacgugcgcuccaccaagcugcggauggucacgggccugcgcaacauccccagcauccagucccggggccucuucggggccaucgcgggcuucaucgagggcggguggaccgggaugaucgacggcugguacggguaccaccaccagaacgagcagggcagcggcuacgccgccgaccagaaguccacccagaacgccaucaacgggaucaccaacaaggugaacagcgugaucgagaagaugaacacgcaguucaccgccgucggcaaggaguucaacaaccuggagaagcgcauggagaaccugaacaagaagguggacgacggguuccucgacaucuggaccuacaacgcggagcugcuggugcuccuggagaacgagcggacccuggacuuccacgacuccaacgucaagaaccucuacgagaaggugaagaaccagcugcgcaacaacgccaaggagaucggcaacgggugcuucgaguucuaccacaagugcaacaacgagugcauggagagcgucaagaacggcacguacgacuaccccaaguacuccgaggagagcaagcugaaccgggagaagaucgacggcgugaagcucgaguccauggggguguaccagauccuggccaucuacagcaccgccgccagcucccugguccuccuggugagccugggcgcgaucuccuucuggaugugcagcaacgggucccuccagugccgcaucugcaucuga

SEQ ID NO: 62624 - RNA, 1701 nt, Artificial Sequence
  derived and/or modified sequence opt1 from hemagglutinin__InfluenzaA__ABO38384
augaaggcccgccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccggcugaagggcaucccgccccuccagcuggggaagugcaacaucgcgggcuggcugcucgggaaccccgagugcgacucccugcugcccgcccgcagcugguccuacaucguggagacgcccaacagcgagaacggcgccugcuacccgggcgacuucaucaacuacgaggagcuccgggagcagcuguccagcgucuccagcuucgagcgcuucgagaucuuccccaaggaguccagcuggcccaagcacaacaccaccaagggggugaccgccgcgugcucccacgccggcaagagcuccuucuaccggaaccugcucuggcugacgaagaaggaggacagcuaccccaagcugaagaacuccuacgugaacaagaaggggaaggagguccucgugcuguggggcgugcaccacccgagcuccagcaaggagcagcagacccuguaccagaacgagaacgccuacgucagcgugguguccagcaacuacaaccgccgguucacccccgagaucgccgagcgccccaagguccgggaccagaccgggcgcaugaacuacuacuggacgcuccuggagcccggcgacaccaucaucuucgaggccaacggcaaccugaucgcgccgugguacgccuucgcccucucccggggguucggcagcgggaucaucaccuccaacgccagcaugcacgagugcaacaccaagugccagacgccccagggcgccaucaacuccagccugcccuuccagaacauccaccccgugaccaucggcgagugcccgaaguacgugcgcuccgcgaagcugcggauggucaccgggcuccgcaacauccccagcauccagucccggggccuguucggggccaucgccggcuucaucgagggcggguggaccggcaugaucgacgggugguacggcuaccaccaccagaacgagcaggggagcggcuacgccgccgaccagaaguccacgcagaacgcgaucaacgggaucaccaacaaggugaacagcgugaucgagaagaugaacacccaguucaccgccgucggcaaggaguucaacaaccuggagaagcgcauggagaaccucaacaagaagguggacgacggcuuccuggacaucuggacguacaacgccgagcugcucgugcugcuggagaacgagcggacccucgacuuccacgacuccaacgucaagaaccuguacgagaaggucaagagccagcugaagaacaacgccaaggagaucgggaacggcugcuucgaguucuaccacaagugcgacaacgagugcauggaguccgugcgcaacgggaccuacgacuaccccaaguacagcgaggaguccaagcucaaccgggagaagaucgacggcgugaagcuggagagcauggggguguaccagauccuggccaucuacagcaccgucgcguccagccucgugcugcuggugucccucggcgccaucagcuucuggaugugcuccaacggcagccugcagugccgcaucugcaucuga

SEQ ID NO: 62625 - RNA, 1701 nt, Artificial Sequence
  derived and/or modified sequence opt1 from hemagglutinin__InfluenzaA__ABO38395
augaaggccaagcugcucgugcugcugugcgccuucaccgcgaccgacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggagcuacaucgccgagacccccaacagcgagaacgggaccugcuaccccggcuacuucgccgacuacgaggagcuccgggagcagcuguccagcguguccagcuucgagcgcuucgagaucuuccccaaggaguccagcuggccgaaccacacggucaccaagggggugaccgccuccugcagccacaagggccgguccagcuucuaccgcaaccugcucuggcugaccaagaagaacggguccuaccccaaccugagcaagagcuacgugaacaacaaggagaaggagguccucgugcuguggggcgugcaccaccccuccaacaucggggaccagcgggccaucuaccacacggagaacgcguacgucagcgugguguccagccacuacaaccgccgguucacccccgagaucgccaagcgcccgaagguccgggaccaggagggccgcaucaacuacuacuggacccugcucgagcccggcgacaccaucaucuucgaggccaacgggaaccugaucgcccccugguacgccuucgcgcugucccggggcuucgggagcggcaucaucacguccaacgccagcauggacgagugcgacgccaagugccagacgccccagggcgccaucaacuccagccucccguuccagaacgugcaccccgugaccaucggggagugccccaaguacguccgcuccaccaagcugcggauggugaccggccugcgcaacauccccagcauccagucccggggccucuucggcgccaucgcgggguucaucgagggcggcuggaccgggaugaucgacggcugguacggguaccaccaccagaacgagcagggcagcggguacgccgccgaccagaaguccacccagaacgccaucaacggcaucaccaacaaggugaacagcgucaucgagaagaugaacacgcaguucaccgccgugggcaaggaguucaacaagcuggagcgccggauggagaaccugaacaagaagguggacgacggguuccucgacaucuggaccuacaacgcggagcugcugguccuccuggagaacgagcgcacccuggacuuccacgacuccaacgugaagaaccucuacgagaaggucaagagccagcugaagaacaacgccaaggagaucggcaacgggugcuucgaguucuaccacaagugcaacaacgagugcauggaguccgugaagaacggcacguacgacuacccgaaguacagcgaggagagcaagcugaaccgggagaagaucgacggggugaagcucgaguccaugggcgucuaccagauccuggccaucuacagcaccguggccuccagccuggugcuccuggucucccugggcgccaucagcuucuggaugugcuccaacgggagccuccagugccgcaucugcaucuga

SEQ ID NO: 62626 - RNA, 1701 nt, Artificial Sequence
  derived and/or modified sequence opt1 from hemagglutinin__InfluenzaA__ABO38406
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggagcuacaucgccgagacccccaacagcgagaacgggaccugcuaccccggcuacuucgccgacuacgaggagcugcgcgagcagcuguccagcguguccagcuucgagcgguucgagaucuuccccaaggaguccagcuggccgaaccacaacgucaccaagggggugacggccuccugcagccacaagggcaaguccagcuucuaccgcaaccuccuguggcugaccgagaagaagggguccuaccccaaccucagcaagagcuacgugaacaacaaggagaaggagguccuggugcuguggggcauccaccaccccuccaacaucgaggaccagaagaccaucuaccggaaggagaacgccuacgugagcgucguguccagccacuacaaccgccgguucacccccgagaucgcgaagcgcccgaaggugcgggaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgagcauggacgagugcgacgccaagugccagacgccccgcggcgccaucaacuccagccugccguuccagaacguccaccccgugaccaucggcgagugccccaaguacgugcgguccaccaagcugcgcauggucaccgggcuccggaacauccccagcauccagucccgcggccuguucggggccaucgccggcuucaucgagggcggcuggaccggcaugaucgacgggugguacggcuaccaccaccagaacgagcaggggagcggcuacgcggccgaccagaaguccacgcagagcgccaucaacgggaucaccaacaaggugaacuccaucaucgagaagaugaacacccaguucaccgccgugggcaaggaguucaacaagcuggagaagcggauggagaaccucaacaagaaggucgacgacggcuuccuggacaucuggacguacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuacccgaaguacagcgaggaguccaagcucaaccgggagaagaucgacggcgucaagcuggagagcauggggguguaccagauccuggccaucuacuccaccguggccagcucccucguccugcuggugagccucggcgccaucuccuucuggaugugcagcaacggcucccugcagugccgcaucugcaucuga

SEQ ID NO: 62627 - RNA, 1701 nt, Artificial Sequence
  derived and/or modified sequence opt1 from hemagglutinin__InfluenzaA__ABO38417
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcucccccaccggccgcaucugcgacagcccccaccagauccuggacggggagaacugcacccugaucgacgcccuccugggcgacccccacugcgacggguuccagaacaaggagugggaccuguucguggagcgguccacggccuacagcaacugcuacccguacgacguccccgacuacgcgucccuccgcagccugguggccuccagcggcacccuggaguucaacaacgaguccuucaacuggaccggcguggcccagaacgggaccagcuccgccugcaagcggcgcagcaucaaguccuucuucagccggcucaacuggcugcaccagcugaaguacaaguaccccgcgcucaacgucacgaugcccaacaacgagaaguucgacaagcuguacaucuggggcgugcaccacccguccaccgacagcgaccagaucucccuguacgcccaggccagcgggcgcgugaccgucagcaccaagcggucccagcagacggugauccccaacaucggcagccgccccugggugcgcggggucuccagccggaucuccaucuacuggaccaucgugaagcccggcgacauccuccugaucaacagcaccggcaaccugaucgccccgcggggguacuucaagauccgcuccggcaagagcuccaucaugcggagcaacacccccaucgggaagugcaacuccgagugcaucacgcccaacggcagcauccccaacgacaagccguuccagaacgugaaccgcaucaccuacggcgccugcccccgguacgucaagcagaacacccucaagcuggcgaccgggaugcgcaacgugcccgagaagcagacgcggggcaucuucggggccaucgccggcuucaucgagaacgggugggagggcaugguggacggcugguacggguuccgccaccagaacuccgagggcaccgggcaggccgccgaccucaagagcacccaggcggccaucaaccagaucaacggcaagcugaaccggcugaucgagaagaccaacgagaaguuccaccagaucgagaaggaguucuccgaggucgaggggcgcauccaggaccuggagaaguacguggaggacacgaagaucgaccucuggagcuacaacgccgagcugcugguggcccucgagaaccagcacaccaucgaccugaccgacuccgagaugaacaagcuguucgagcggacccgcaagcagcuccgcgagaacgccgaggacaugggcaacggcugcuucaagaucuaccacaagugcgacaacgcgugcaucgggagcauccggaacggcacguacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggguucaucaugugggccugccagaagggcaacauccgcugcaacaucugcaucuga

SEQ ID NO: 62628 - RNA, 1689 nt, Artificial Sequence
  derived and/or modified sequence opt1 from hemagglutinin__InfluenzaA__ABO38712
auggccaucaucuacuucauccugcuguucaccgccgugcgcggcgaccagaucugcaucggguaccacgcgaacaacagcaccgagaaggucgacacgauccuggagcggaacgugaccgugacccacgccaaggacauccuggagaagacccacaacggcaagcucugcaagcugaacgggaucccgccccuggagcucggcgacugcuccaucgccggguggcugcugggcaaccccgagugcgaccgccuccugcggguccccgaguggagcuacaucauggagaaggagaacccccgcuacucccugugcuacccgggcagcuucaacgacuacgaggagcucaagcaccuccuguccagcgugaagcacuucgagaaggugcggauccuccccaaggacggguggacgcagcacaccaccuccggcgggagcaaggccugcgccgucuccggcaagagcuccuucuuccgcaacaugguguggcugaccaagaaggggcccaacuaccccguggcgaagcggagcuacaacaacacguccggcgagcagaugcugaucaucuggggcguccaccacccgaaggacgaggccgagcagcgcgcccucuaccagaagguggggaccuacgugagcgccuccaccagcacccugaacaagcgguccacgcccgagaucgcggcccgccccgaggucaacggccuggggagccggauggaguucuccuggacccuccuggacgugugggacaccaucaacuucgagagcaccggcaaccugguggcccccgaguacggcuucaagaucagcaagcgcggguccagcggcaucaugaagacggaggggacccucggcaacugcgagaccaagugccagaccccgcugggggccaucaacacgacccugcccuuccacaacguccacccccucaccaucggcgagugccccaaguacgugaaguccgagaagcuggugcuggccaccggccuccggaacgucccgcagaucgagagccgcgggcuguucggcgcgaucgccggguucaucgagggcggguggcagggcaugguggacggcugguacggguaccaccacuccaacgaccagggcagcggguacgccgccgacaaggaguccacgcagaaggccuucgaccggaucaccaacaaggugaacagcgucaucgagaagaugaacacccaguucgaggcggugggcaaggaguucuccaaccuggagaagcgccucgagaaccugaacaagaagauggaggacggguuccuggacguguggaccuacaacgccgagcuccugguccugauggagaacgagcggacgcucgacuuccacgacagcaacgugaagaaccuguacaacaagguccgcaugcagcugcgggacaacgugaaggagcucggcaacggcugcuucgaguucuaccacaagugcgacgacgagugcauguccagcgugaagaacgggaccuacgacuaccccaaguacgaggaggaguccaagcugaagcgcaacgagaucaagggcgucaagcugagcuccauggggguguaccagauccucgccaucuacgccaccguggccggcagccugucccuggcgaucaugaucgccggcaucagccucuggaugugcuccaacgggagccugcagugccggaucugcaucuga

SEQ ID NO: 62629 - RNA, 1689 nt, Artificial Sequence
  derived and/or modified sequence opt1 from hemagglutinin__InfluenzaA__ABO38723
auggccaucaucuacuucauccugcuguucaccgccgugcgcggcgaccagaucugcaucggguaccacgcgaacaacagcaccgagaaggucgacacgauccuggagcggaacgugaccgugacccacgccaaggacauccuggagaagacccacaacggcaagcucugcaagcugaacgggaucccgccccuggagcucggcgacugcuccaucgccggguggcugcugggcaaccccgagugcgaccgccuccugcggguccccgaguggagcuacaucauggagaaggagaacccccgcuacucccugugcuacccgggcagcuucaacgacuacgaggagcucaagcaccuccuguccagcgugaagcacuucgagaaggugcggauccuccccaaggacggguggacgcagcacaccaccuccggcgggagcaaggccugcgccgucuccggcaagagcuccuucuuccgcaacaugguguggcugaccaagaaggggcccaacuaccccguggcgaagcggagcuacaacaacacguccggcgagcagaugcugaucaucuggggcguccaccacccgaacgacgaggccgagcagcgcgcccucuaccagaagguggggaccuacgugagcgccuccaccagcacccugaacaagcgguccacgcccgagaucgcggcccgccccgaggucaacggccuggggagccggauggaguucuccuggacccuccuggacgugugggacaccaucaacuucgagagcaccggcaaccugguggcccccgaguacggcuucaagaucagcaagcgcggguccagcggcaucaugaagacggaggggacccucggcaacugcgagaccaagugccagaccccgcugggggccaucaacacgacccugcccuuccacaacguccacccccucaccaucggcgagugccccaaguacgugaaguccgagaagcuggugcuggccaccggccuccggaacgucccgcagaucgagagccgcgggcuguucggcgcgaucgccggguucaucgagggcggguggcagggcaugguggacggcugguacggguaccaccacuccaacgaccagggcagcggguacgccgccgacaaggaguccacgcagaaggccuucgaccggaucaccaacaaggugaacagcgucaucgagaagaugaacacccaguucgaggcggugggcaaggaguucuccaaccuggagaagcgccucgggaaccugaacaagaagauggaggacggcuuccuggacguguggaccuacaacgccgagcuccugguccugauggagaacgagcggacgcucgacuuccacgacagcaacgugaagaaccuguacaacaagguccgcaugcagcugcgggacaacgugaaggagcucggcaacgggugcuucgaguucuaccacaagugcgacgacgagugcauguccagcgugaagaacggcaccuacgacuaccccaaguacgaggaggaguccaagcugaagcgcaacgagaucaagggggucaagcugagcuccaugggcguguaccagauccucgccaucuacgccaccguggccggcagccugucccuggcgaucaugaucgccgggaucagccucuggaugugcuccaacggcagccugcagugccggaucugcaucuga

SEQ ID NO: 62630 - RNA, 1698 nt, Artificial Sequence
  derived and/or modified sequence opt1 from hemagglutinin__InfluenzaA__ABO44046
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaagaugaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacaacgagugcauggagagcgucaagaacgggaccuacgacuaccccaaguacuccgaggagagcaagcucaaccgcgagaagaucgacggcgugaagcuggaguccaugggcguguaccagauccuggccaucuacagcacggucgccagcucccucgugcugcuggugagccucggggccaucuccuucuggaugugcagcaacggcucccugcagugccggaucugcaucuga

SEQ ID NO: 62631 - RNA, 1689 nt, Artificial Sequence
  derived and/or modified sequence opt1 from hemagglutinin__InfluenzaA__ABO44057
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagcuucaacgacuacgaggagcugaagcaccuccuguccagcgugaagcacuucgagaaggugaagauccugcccaaggacggguggacgcagcacgagaccgacggcggguccaaggccugcgccgucagcggcaaggcguccuucuuccggaacaugguguggcugaccaagcgcgggcccaacuaccagguggccaagcggagcuacaacaacaccuccggcgagcagaugcucaucaucuggggcguccaccaccccaaggacgaggccgagcagcgcgcccuguaccagaagguggggacguacgugagcgcguccaccagcacccugaacaagcgguccaccccggagaucgccgcccgccccgaggucaacggccucgagagccggauggaguucuccuggacgcugcuggacgugugggacaccaucaacuucgagagcaccgggaaccucguggcccccgaguacggcuucaagaucuccaagcgcggcagcagcgggaucaugaagaccgagggcacgcuggggaacugcgagaccaagugccagacgccccugggcgccaucaacaccacccucccguuccacaacguccacccccugaccaucggggagugccccaaguacgugaaguccgagaagcuggugcucgcgaccggccugcggaacgucccccagaucgagagccgcggccuguucggggccaucgccggcuucaucgagggcggguggcaggggaugguggacggcugguacggcuaccaccacuccaacgaccaggggagcggcuacgccgccgacaaggaguccacccagaaggcguucgaccggaucacgaacaaggugaacagcgucaucgagaagaugaacauccaguucgaggccguggggaaggaguucuccaaccucgagaagcgccuggagaaccugaacaagaagauggaggacggcuuccucgacguguggaccuacaacgccgagcugcugguccucauggagaacgagcggacccuggacuuccacgacagcaacgugaagaaccuguacgacaagguccgcaugcagcuccgggacaacgugaaggagcuggggaacggcugcuucgaguucuaccacaagugcgacgacgagugcaugaacuccgugaagaacggcaccuacgacuacccgaaguacgaggaggagagcaagcugaagcgcaacgagaucaagggggucaagcucuccagcaugggcguguaccagauccuggccaucuacgccacgguggcggggucccugagccucgccaucaugaucgccggcaucuccuucuggaugugcagcaacggcucccugcagugccgggucugcaucuga

SEQ ID NO: 62632 - RNA, 1701 nt, Artificial Sequence; identical to SEQ ID NO: 61264
  derived and/or modified sequence opt1 from hemagglutinin__InfluenzaA__ABO44079

SEQ ID NO: 62633 - RNA, 1689 nt, Artificial Sequence
  derived and/or modified sequence opt1 from hemagglutinin__InfluenzaA__ABO44090
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcgacggccucugcuacccgggguccuucaacgacuacgaggagcugaagcaccuccugagcuccgugaagcacuucgagaaggugaagauccugcccaaggaccgguggacgcagcacaccaccaccggcgggagccgcgccugcgccgucuccggcaaccccagcuucuuccggaacaugaucuggcugacgaagaagggguccaacuaccccguggcgaagggcagcuacaacaacaccuccggcgagcagaugcucaucaucuggggcgugcaccacccgaacgacgagaccgagcagcgcacccuguaccagaacgucgggacguacgugagcguggucaccuccacccugaacaagcggagcacccccaagaucgccacgcgccccaaggugaacgggcucggcggccggauggaguucuccuggacccugcuggacaugugggacaccaucaacuucgagagcaccgggaaccucaucgcccccgaguacggcuucaagaucuccaagcgcgggagcuccggcaucaugaagacggaggggacccuggagaacugcgagaccaagugccagaccccgcugggcgccaucaacacgacccuccccuuccacaacgugcacccccugaccaucggcgagugccccaaguacgucaagagcgagaagcuggugcucgcgaccgggcugcggaacgugccgcagaucgagagccgcggccuguucggggccaucgccggcuucaucgagggcggguggcagggcauggucgacgggugguacggcuaccaccacuccaacgaccaggggagcggcuacgccgccgacaaggaguccacgcagcgggcguucgacgggaucaccaacaaggugaacagcgugaucgagaagaugaacacccaguucgaggccgucggcaaggaguucuccaaccucgagcgccggcuggagaaccugaacaagaagauggaggacggccuccuggacguguggaccuacaacgccgagcugcucgugcugauggagaacgagcgcauccuggacuuccacgacagcaacgucaagaaccucuacgacaaggugcggaugcagcugcgcgacaacgucaaggagcuggggaacggcugcuucgaguucuaccacaagugcgacgacgagugcaugaacuccgugaagaacgggacguacgacuaccccaaguacgaggaggagagcaagcucaaccggaacgagaucaagggcgugaagcuguccagcaugggcgucuaccagauccuggccaucuacgccaccguggcggggucccucagccuggccaucaugauggccggcaucuccuucuggaugugcagcaacgggucccugcagugccgcaucugcaucuga

SEQ ID NO: 62634 - RNA, 1689 nt, Artificial Sequence
  derived and/or modified sequence opt1 from hemagglutinin__InfluenzaA__ABO44101
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagcuucaacgacuacgaggagcugaagcaccuccuguccagcgugaagcacuucgagaaggugaagauccugcccaaggacggguggacgcagcacaagaccgacggcggguccaaggccugcgccgucagcggcaagcccuccuucuuccggaacaugguguggcugaccaagaaggggcccaacuacccgguggcgaagcgcagcuacaacaacaccuccggcgagcagaugcucaucaucuggggcguccaccaccccaacgacgaggccgagcagcgggcccuguaccagaagguggggacguacgugagcgccuccaccagcacccugaacaagcgcuccacccccgagaucgcggcccggcccgaggucagcggccucgggucccgcauggaguucagcuggacgcugcuggacgugugggacaccaucuccuucgagagcaccggcaaccucguggccccggaguacggcuucaagaucagcaagcggggguccagcggcaucaugaagaccgaggggacgcugggcaacugcgagaccaagugccagacgccccugggggccaucaacaccacccuccccuuccacaacguccacccccugaccaucggcgagugcccgaaguacgugaaguccgagaagcuggugcucgccaccggccugcgcaacgucccccagaucgagagccgggggcuguucggcgcgaucgccggguucaucgagggcggguggcagggcaugguggacggcugguacggguaccaccacuccaacgaccagggcagcggguacgccgccgacaaggaguccacccagaaggccuucgaccgcaucacgaacaaggugaacagcgucaucgagaagaugaacacccaguucgaggcggugggcaaggaguucuccaaccucgagaagcggcuggagaaccugaacaagaagauggaggacggguuccucgacguguggaccuacaacgccgagcugcugguccucauggagaacgagcgcacccuggacuuccacgacagcaacgugaagaaccuguacgacaagguccggaugcagcuccgcgacaacgugaaggagcugggcaacggcugcuucgaguucuaccacaagugcgacgacgagugcaugaacuccgugaagaacgggacguacgacuaccccaaguacgaggaggagagcaagcugaagcggaacgagaucaagggcgucaagcucuccagcauggggguguaccagauccuggccaucuacgccaccguggccggcucccugagccucgcgaucaugaucgccggcaucuccuucuggaugugcagcaacgggucccugcagugccgcaucugcaucuga

SEQ ID NO: 62635 - RNA, 1701 nt, Artificial Sequence
  derived and/or modified sequence opt1 from hemagglutinin__InfluenzaA__ABO44123
augaaggccaagcugcucgugcugcugugcgccuucaccgcgaccgacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggagcuacaucgccgagacccccaacagcgagaacgggaccugcuaccccggcuacuucgccgacuacgaggagcuccgggagcagcuguccagcguguccagcuucgagcgcuucgagaucuuccccaaggaguccagcuggccgaaccacacggucaccaagggggugaccgccuccugcagccacaagggcaaguccagcuucuaccggaaccugcucuggcugaccaagaagaacggguccuaccccaaccugagcaagagcuacgugaacaacaaggagaaggagguccucgugcuguggggcgugcaccaccccuccaacaucggggaccagcgcgccaucuaccacacggagaacgcguacgucagcgugguguccagccacuacaaccggcgcuucacccccgagaucgccaagcggccgaagguccgcgaccaggagggccggaucaacuacuacuggacccugcucgagcccggcgacaccaucaucuucgaggccaacgggaaccugaucgcccccugguacgccuucgcgcugucccgcggcuucgggagcggcaucaucacguccaacgccagcauggacgagugcgacgccaagugccagacgccccagggcgccaucaacuccagccucccguuccagaacgugcaccccgugaccaucggggagugccccaaguacguccgguccaccaagcugcgcauggugaccggccugcggaacauccccagcauccagucccgcggccucuucggcgccaucgcgggguucaucgagggcggcuggaccgggaugaucgacggcugguacggguaccaccaccagaacgagcagggcagcggguacgccgccgaccagaaguccacccagaacgccaucaacggcaucaccaacaaggugaacagcgucaucgagaagaugaacacgcaguucaccgccgugggcaaggaguucaacaagcuggagcggcgcauggagaaccugaacaagaagguggacgacggguuccucgacaucuggaccuacaacgcggagcugcugguccuccuggagaacgagcggacccuggacuuccacgacuccaacgugaagaaccucuacgagaaggucaagagccagcugaagaacaacgccaaggagaucggcaacgggugcuucgaguucuaccacaagugcaacaacgagugcauggaguccgugaagaacggcacguacgacuacccgaaguacagcgaggagagcaagcugaaccgcgagaagaucgacggggugaagcucgaguccaugggcgucuaccagauccuggccaucuacagcaccguggccuccagccuggugcuccuggucucccugggcgccaucagcuucuggaugugcuccaacgggagccuccagugccggaucugcaucuga

SEQ ID NO: 62636 - RNA, 1701 nt, Artificial Sequence
  derived and/or modified sequence opt1 from hemagglutinin__InfluenzaA__ABO44134
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagcggagcuggccgaagcacaacgucacccgcggcgugacggccuccugcagccacaagggcaaguccagcuucuaccggaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccgcaaggagaacgccuacgucagcgugguguccagcaacuacaaccggcgcuucacccccgagaucgcggagcggccgaagguccgcgggcaggccggccggaucaacuacuacuggacgcuccuggagcccggcgacaccaucaucuucgaggccaacgggaaccugaucgcccccuggcacgccuucgcgcucucccgcggcuucgggagcggcaucaucaccuccaacgccagcauggacgagugcgacaccaagugccagacgccccagggcgccaucaacuccagccugccguuccagaacauccaccccgugaccaucggggagugccccaaguacgugcgguccaccaagcugcgcauggucaccggccuccggaacauccccagcauccagucccgcgggcuguucggcgccaucgccggguucaucgagggcggcuggacggggaugaucgacggcugguacggguaccaccaccagaacgagcagggcagcggguacgcggccgaccagaaguccacccagaacgccaucaacggcaucaccaacaaggugaacagcgugaucgagaagaugaacacccaguucacggccgucggcaaggaguucaacaagcuggagaagcggauggagaaccucaacaagaagguggacgacggguuccuggacaucuggaccuacaacgccgagcugcucgugcugcuggagaacgagcgcacccucgacuuccacgacuccaacgucaagaaccuguacgagaaggucaagagccagcugaagaacaacgcgaaggagaucggcaacgggugcuucgaguucuaccacaagugcaacaacgagugcauggaguccgugaagaacggcaccuacgacuacccgaaguacagcgaggagagcaagcucaaccgggagaagaucgacggggugaagcuggaguccaugggcguguaccagauccuggccaucuacagcacggucgccuccagccucgugcugcuggugucccucggcgccaucagcuucuggaugugcuccaacgggagccugcagugccgcaucugcaucuga

SEQ ID NO: 62637 - RNA, 1701 nt, Artificial Sequence
  derived and/or modified sequence opt1 from hemagglutinin__InfluenzaA__ABO52071
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccuccaccgacaacgaccagaucagccuguacgcgcaggccuccgggcggaucaccgugagcacgaagcgcagccagcagaccgugaucccgaacaucggcucccggccccgcguccgggacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 62638 - RNA, 1701 nt, Artificial Sequence
  derived and/or modified sequence opt1 from hemagglutinin__InfluenzaA__ABO52225
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagacccccaaccccgagaacggcacgugcuaccccggcuacuucgccgacuacgaggagcucaaggagcagcugagcuccgucagcuccuucgagcgguucgagaucuucccgaaggagagcuccuggcccaaccacaccgugaccaagggggugaccgccagcugcucccacaacggcaagagcuccuucuacaagaaccugcucuggcugacggagaagaacgggcuguaccccaaccucagcaaguccuacgucaacaacaaggagaaggaggugcuggugcuguggggcguccaccaccccagcaacaucggggaccagcgcgccaucuaccacaccgagaacgcguacgugagcguggucuccagccacuacucccggcgcuucaccccggagaucgccaagcggcccaaggugcgcgaccaggagggccggaucaacuacuacuggacccuccuggagcccggcgacacgaucaucuucgaggccaacgggaaccugaucgcccccugguacgccuucgcgcucagccgcggcuucggguccggcaucaucaccagcaacgccuccaugggcgagugcgacgccaagugccagaccccgcagggggccaucaacagcucccugcccuuccagaacgugcaccccgucaccaucggcgagugccccaaguacgugcggagcacgaagcugcgcauggugaccgggcuccggaacaucccguccauccagagccgcggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucacgaacaaggucaacagcgugaucgagaagaugaacacccaguucaccgccguggggaaggaguucaacaagcuggagcggcgcauggagaaccucaacaagaaggucgacgacggcuuccuggacaucuggaccuacaacgcggagcugcucgugcugcuggagaacgagcggacgcucgacuuccacgacagcaacgucaagaaccuguacgagaaggugaagaaccagcugaagaacaacgccaaggagaucgggaacggcugcuucgaguucuaccacaagugcaacgacgagugcauggaguccgugaagaacgggaccuacgacuaccccaaguacagcgaggaguccaagcucaagcgcgagaagaucgacggcgucaagcuggagagcaugggcguguaccagauccuggccaucuacagcaccguggccuccagccucguccugcuggugucccucggggccaucagcuucuggaugugcuccaacggcagccugcagugccggaucugcaucuga

SEQ ID NO: 62639 - RNA, 1689 nt, Artificial Sequence
  derived and/or modified sequence opt1 from hemagglutinin__InfluenzaA__ABO52236
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcacuuccuguccagcgugaagcacuucgagaaggugaagauccuccccaaggaccgcuggacgcagcacaccaccaccggcgggucccgggccugcgccgucagcggcaaccccuccuucuuccgcaacaugguguggcugacgaagaaggggagcaacuaccccguggcgaagggcuccuacaacaacaccagcggcgagcagaugcugaucaucuggggcguccaccacccgaacgacgagaccgagcagcggacccucuaccagaacguggggacguacguguccgucgggaccagcacccugaacaagcgcuccacccccgacaucgccacgcggcccaaggugaacggccugggcgggcgcauggaguucagcuggacccuccuggacaugugggacaccaucaacuucgaguccaccggcaaccugaucgcccccgaguacggguucaagaucagcaagcggggcuccagcgggaucaugaagacggagggcacccucggcaacugcgagaccaagugccagaccccgcugggggccaucaacacgacccugcccuuccacaacgugcacccccucaccaucggcgagugccccaaguacgucaagagcgagaagcuggugcuggcgaccgggcuccgcaacgugccgcagaucgagucccggggccuguucggggccaucgccggcuucaucgagggcggguggcagggcauggucgacgggugguacggcuaccaccacagcaacgaccagggguccggcuacgccgccgacaaggagagcacgcagaaggcguucgacggcaucaccaacaaggugaacuccgugaucgagaagaugaacacccaguucgaggccgucgggaaggaguucagcaaccuggagcgccggcucgagaaccugaacaagaagauggaggacggcuuccuggacguguggaccuacaacgccgagcuccuggugcugauggagaacgagcgcacgcucgacuuccacgacuccaacgucaagaaccuguacgacaaggugcggaugcagcugcgcgacaacgccaaggagcucgggaacggcugcuucgaguucuaccacaagugcgacgacgagugcaugaacagcgucaagaacggcaccuacuacuaccccaaguacgaggaggaguccaagcugaaccggaacgagaucaagggggugaagcugagcuccaugggcguguaccagauccucgccaucuacgcgaccgucgccgggagccugucccuggccaucaugauggccggcaucagcuucuggaugugcuccaacgggagccuccagugccgcaucugcaucuga

SEQ ID NO: 62640 - RNA, 1689 nt, Artificial Sequence
  derived and/or modified sequence opt1 from hemagglutinin__InfluenzaA__ABO52247
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagcuucaacgacuacgaggagcugaagcaccuccuguccagcgugaagcacuucgagaaggugaagauccugcccaaggacggguggacgcagcacaagaccgacggcggguccaaggccugcgccgucagcggcaagcccuccuucuuccggaacaugguguggcugaccaagaaggggcccaacuacccgguggcgaagcgcagcuacaacaacaccuccggcgagcagaugcucaucaucuggggcguccaccaccccaacgacgaggccgagcagcgggcccuguaccagaagguggggacguacgugagcgccuccaccagcacccugaacaagcgcuccacccccgagaucgcggcccggcccgaggucagcggccucgggucccgcauggaguucagcuggacgcugcuggacgugugggacaccaucuccuucgagagcaccggcaaccucguggccccggaguacggcuucaagaucagcaagcggggguccagcggcaucaugaagaccgaggggacgcugggcaacugcgagaccaagugccagacgccccugggggccaucaacaccacccuccccuuccacaacguccacccccugaccaucggcgagugcccgaaguacgugaaguccgagaagcuggugcucgccaccggcccccgcaacgucccccagaucgagagccgggggcuguucggcgcgaucgccggguucaucgagggcggguggcagggcaugguggacggcugguacggguaccaccacuccaacgaccagggcagcggguacgccgccgacaaggaguccacccagaaggccuucgaccgcaucacgaacaaggugaacagcgucaucgagaagaugaacacccaguucgaggcggugggcaaggaguucuccaaccuggagaagcggcucgagaaccugaacaagaagauggaggacggguuccuggacguguggaccuacaacgccgagcuccugguccugauggagaacgagcgcacccucgacuuccacgacagcaacgugaagaaccuguacgacaagguccggaugcagcugcgcgacaacgugaaggagcucggcaacggcugcuucgaguucuaccacaagugcgacgacgagugcaugaacuccgugaagaacgggacguacgacuaccccaaguacgaggaggagagcaagcugaagcggaacgagaucaagggcgucaagcuguccagcauggggguguaccagauccucgccaucuacgccaccguggccggcucccugagccuggcgaucaugaucgccggcaucuccuucuggaugugcagcaacgggucccuccagugccgcaucugcaucuga

SEQ ID NO: 62641 - RNA, 1701 nt, Artificial Sequence
  derived and/or modified sequence opt1 from hemagglutinin__InfluenzaA__ABO52258
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagagcuccuggccgaagcacaacgucacccgcggggugacggccagcugcucccacaagggcaagugcagcuucuaccggaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccggaaggagaacgccuacgucagcgugguguccagccacuacaaccgccgguucacccccgagaucgcgaagcgcccgaagguccgggaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgagcauggacgagugcgacgccaagugccagacgccccagggcgccaucaacuccagccugccguuccagaacgugcaccccgugaccaucggcgagugccccaaguacguccgcuccaccaagcugcggauggugaccgggcuccgcaacauccccagcauccagucccggggccuguucggggccaucgccggcuucaucgagggcggcuggaccggcaugaucgacgggugguacggcuaccaccaccagaacgagcaggggagcggcuacgcggccgaccagaaguccacgcagaacgccaucaacgggaucaccaacaaggugaacagcgucaucgagaagaugaacacccaguucaccgccgugggcaaggaguucaacaagcuggagaagcgcauggagaaccucaacaagaagguggacgacggcuuccuggacaucuggacguacaacgccgagcugcucguccugcuggagaacgagcggacccucgacuuccacgacuccaacgugaagaaccuguacgagaaggucaagagccagcugaagaacaacgcgaaggagaucgggaacggcugcuucgaguucuaccacaagugcaacaacgagugcauggaguccgugaagaacgggaccuacgacuacccgaaguacagcgaggagagcaagcucaaccgcgagaagaucgacggcgugaagcuggaguccaugggggucuaccagauccuggccaucuacagcaccguggccuccagccucgugcugcuggucucccucggcgccaucagcuucuggaugugcuccaacggcagccugcagugccggaucugcaucuga

SEQ ID NO: 62642 - RNA, 1701 nt, Artificial Sequence
  derived and/or modified sequence opt1 from hemagglutinin__InfluenzaA__ABO52280
augaaggcccgccugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccggcugaagggcaucgcgccccuccagcuggggaagugcaacaucgccggcuggauccuggggaacccggagugcgagagccuccuguccaaccgcagcugguccuacaucgccgagacccccaacagcgagaacggcaucugcuaccccggcgacuucgccgacuacgaggagcugcgggagcagcucuccagcguguccagcuucgagcgcuucgagaucuuccccaaggaguccagcuggccgaagcacaacaucacccgcggggugaccgucgccugcucccacgccaagaaguccagcuucuacaagaaccugcuguggcucacggaggcgaacggccuguaccccagccuguccaagagcuacgugaacgaccgggagaaggaggugcucguccuguggggcgugcaccaccccagcaacaucgaggaccagcggacccuguaccgcaaggagaacgccuacguguccgucgugagcuccaacuacaaccggcgcuucacccccgagaucgccgagcggccgaaggugcgcgggcagcccgggcggaugaacuacuacuggacccuccuggagcccggcgacaagaucaucuucgaggccaacggcaaccugaucgcccccugguacgcguucgcccucagccgcgggccgggcuccgggaucaucacgagcaacgccuccauggacgagugcgacaccaagugccagacgccccagggcgccaucaacagcucccugcccuuccagaacauccaccccgucaccaucggcgagugcccgaaguacgugcggagcaccaagcugcgcauggugaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacgggaucacgaacaaggugaacagcgugaucgagaagaugaacacccaguucaccgccgucggcaaggaguucaacaagcuggagaagcggauggagaaccucaacaagaagguggacgacggcuuccuggacaucuggaccuacaacgcggagcugcucgugcugcuggagaacgagcgcacgcucgacuuccacgacagcaacgucaagaaccuguacgagaaggugaagaaccagcugcggaacaacgccaaggagaucgggaacggcugcuucgaguucuaccacaagugcgacaacgagugcauggaguccgucaagaacgggaccuacgacuaccccaaguacagcgaggaguccaagcucaaccgcgccaagaucgacggcgugaagcuggagagcauggggguguaccagauccuggccaucuacagcaccgucgccuccagccucgugcugcuggugucccucggcgcgaucagcuucuggaugugcuccaacggcagccugcagugccgcaucugcaucuga

SEQ ID NO: 62643 - RNA, 1689 nt, Artificial Sequence
  derived and/or modified sequence opt1 from hemagglutinin__InfluenzaA__ABO52302
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcaacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgacaucgccacgcggcccaaggugaacggccucggcgggcgcauggaguucagcuggacccugcuggacaugugggacaccaucaacuucgaguccaccggcaaccucaucgcccccgaguacggguucaagaucagcaagcggggcuccagcgggaucaugaagacggagggcacccugggcaacugcgagaccaagugccagaccccgcugggggccaucaacacgacccuccccuuccacaacgugcacccccugaccaucggcgagugccccaaguacgucaagagcgagaagcuggugcucgcgaccgggcugcgcaacgugccgcagaucgagucccggggccuguucggggccaucgccggcuucaucgagggcggguggcagggcauggucgacgggugguacggcuaccaccacagcaacgaccagggguccggcuacgccgccgacaaggagagcacgcagaaggcguucgacggcaucaccaacaaggugaacuccgugaucgagaagaugaacacccaguucgaggccgucgggaaggaguucagcaaccucgagcgccggcuggagaaccugaacaagaagauggaggacggcuuccucgacguguggaccuacaacgccgagcugcuggugcucauggagaacgagcgcacgcuggacuuccacgacuccaacgucaagaaccuguacgacaaggugcggaugcagcuccgcgacaacgucaaggagcuggggaacggcugcuucgaguucuaccacaagugcgacgacgagugcaugaacagcgugaagaacggcaccuacgacuaccccaaguacgaggaggaguccaagcugaaccggaacgagaucaagggggugaagcucagcuccaugggcaucuaccagauccuggccaucuacgccaccgucgcggggagccugucccucgccaucaugauggccggcaucagcuucuggaugugcuccaacgggagccugcagugccgcaucugcaucuga

SEQ ID NO: 62644 - RNA, 1701 nt, Artificial Sequence
  derived and/or modified sequence opt1 from hemagglutinin__InfluenzaA__ABO52313
augaagaccaucaucgcccugagcuacaucuucugccucguguucgcccagaaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcaacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcuccaacgccugcaagcgggggcccgacagcggcuucuucucccgccugaacuggcucuacaagagcggcuccaccuaccccgugcugaacgucacgaugcccaacaacgacaacuucgacaagcuguacaucuggggcgugcaccacccgagcaccgaccaggagcagaccaaccucuacgugcaggccuccgggcgggucaccgugagcacgaagcgcucccagcagaccaucauccccaacguggggagccggcccuggguccgcggccugagcucccggaucagcaucuacuggaccaucgugaagcccggcgacauccuggugaucaacuccaacgggaaccucaucgcgccgcgcggccacuucaagaugcggaccggcaagagcuccaucaugcgcagcgacgcccccaucgggacgugcuccagcgagugcaucacccccaacggguccauccccaacgacaagccguuccagaacgucaacaagaucaccuacggcgccugccccaaguacgugaagcagaacacccugaagcuggccacgggcaugcggaacgugcccgagaagcagacccgcgggaucuucggcgccaucgcgggguucaucgagaacggcugggaggggaugaucgacggcugguacggcuuccggcaccgcaacagcgaggggaccggccaggccgccgaccucaaguccacccaggccgccaucgaccagaucaacgggaagcugaaccgggucaucgagaagacgaacgagaaguuccaccagaucgagaaggaguucagcgagguggagggccgcauccaggaccuggagaaguacguggaggacaccaagaucgaccucugguccuacaacgcggagcugcuggucgcccucgagaaccagcacaccaucgaccugaccgacagcgagaugaacaagcuguucgagaagacgcggcgccagcuccgggagaacgccgaggacauggggaacggcugcuucaagaucuaccacaagugcgacaacgccugcaucggcuccauccgcaacgggaccuacgaccacgacguguaccgcgacgaggcccugaacaaccgguuccagaucaagggcgucgagcucaagagcggguacaaggacuggauccuguggaucuccuucgcgaucagcugcuuccugcugugcguggugcuccugggcuucaucaugugggccugccagaagggcaacauccgcugcaacaucugcaucuga

SEQ ID NO: 62645 - RNA, 1701 nt, Artificial Sequence
  derived and/or modified sequence opt1 from hemagglutinin__InfluenzaA__ABO52335
augaagaccaucaucgcccugagcuacaucuucugccucgugcugggccaggacuucccccgcaacgacaacuccaccgccacgcugugccucgggcaccacgcggucccgaacggcacccuggugaagaccaucaccaacgaccagaucgaggugacgaacgccaccgagcugguccagagcuccagcaccgggaagaucugcaacaacccccaccggauccucgacggcaucgacugcacccugaucgacgcccugcucggggacccccacugcgacggcuuccagaacgagacgugggaccuguucguggagcgcuccaaggccuucagcaacugcuaccccuacgacgugccggacuacgccucccugcggagccucgucgcguccagcggcacccuggaguucaucaacgagggguucaccuggaccggcgugacgcagaacgggggcuccaacgccugcaagcgcgggcccgacagcggcuucuucucccggcugaacuggcucuacaagagcggcaacaccuaccccgugcugaacgucaccaugcccaacaacgacaacuucgacaagcuguacaucuggggcgugcaccacccguccaccgaccaggaccagacgagccucuacgugcaggccuccggccgcgucaccgugagcaccaagcggucccagcagaccgugauccccaacaucgggccccgccccuggguccggggccugagcagccgcaucuccaucuacuggacgaucgugaagccgggcgacauccugcucaucaacagcaacgggaaccugaucgcgccccggggcuacuucaagaugcgcaccgggaaguccagcaucaugcgguccgacgcccccaucgggaccugcaucagcgagugcaucacccccaacggguccaucccgaacgacaagcccuuccagaacgugaacaagaucacguacggcgccugccccaaguacgucaagcagaacacccugaagcucgccaccggcaugcgcaacgugcccgagaagcagacccgggggaucuucggcgccaucgccggguucaucgagaacggcugggaggggaugaucgacggcugguacggcuuccgccaccagaacagcgaggggacgggccaggcggccgaccugaaguccacccaggccgccaucgaccagaucaacgggaagcugaaccgggugaucgagaagaccaacgagaaguuccaccagaucgagaaggaguucagcgaggucgagggccgcauccaggaccucgagaaguacguggaggacaccaagaucgaccugugguccuacaacgccgagcugcucguggcgcuggagaaccagcacacgaucgaccugaccgacagcgagaugaacaagcuguucgagaagacccggcgccagcuccgggagaacgccgaggacauggggaacggcugcuucaagaucuaccaccgcugcgacaacgccugcaucggcuccauccgcaacgggaccuacgaccacgacgucuaccgggacgaggcccugaacaaccgcuuccagaucaagggcguggagcucaagagcggguacaaggacuggauccuguggaucuccuucgccaucagcugcuuccugcucugcgucgugcugcugggcuucaucaugugggcgugccagaagggcaacauccggugcaacaucugcaucuga

SEQ ID NO: 62646 - RNA, 1701 nt, Artificial Sequence
  derived and/or modified sequence opt1 from hemagglutinin__InfluenzaA__ABO52346
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucagcgacugcuaccccuacgacgugccggacuacgcgucccugcgcagccucgucgccuccagcggcacgcuggaguucaucaacgagggguucaacuggaccggcgugacccagaacgggggcuccagcgccugcaagcgggggcccgacaacggcuucuucucccgccugaacuggcucuacaagagcggcuccaccuaccccgugcagaacgucacgaugcccaacaacgacaacagcgacaagcuguacaucuggggcgugcaccacccguccaccgacaaggagcagaccgaccuguacgugcaggccagcgggaaggucaccguguccacgaagcggagccagcagaccgugauccccaacgucgggagccgccccugggugcggggccucuccagccgcguguccaucuacuggaccaucgucaagcccggcgacauccuggugaucaacagcaacgggaaccugaucgcgccgcggggcuacuucaagaugcgcaccgggaaguccagcaucaugcgguccgacgcccccaucggcacgugcagcuccgagugcaucacccccaacgggagcauccccaacgacaagccguuccagaacgugaacaagaucaccuacggcgccugccccaaguacgucaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggugaucgagaagacgaacgagaaguuccaccagaucgagaaggaguucuccgaggucgagggccgcauccaggaccuggagaaguacguggaggacaccaagaucgaccuguggagcuacaacgcggagcuccuggucgcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcagcauccgcaacgggaccuacgaccacgacguguaccgggacgaggcccucaacaaccgcuuccagaucaagggcguggagcugaaguccggguacaaggacuggauccuguggaucagcuucgcgaucuccugcuuccuccugugcgucgugcugcucggcuucaucaugugggccugccagaagggcaacauccgcugcaacaucugcaucuga

SEQ ID NO: 62647 - RNA, 1701 nt, Artificial Sequence
  derived and/or modified sequence opt1 from hemagglutinin__InfluenzaA__ABO52357
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgcccccaucgacacgugcaucuucgagugcaucacccccaacgggagcauccccaacgacaagccguuccagaacgucaacaagaucaccuacggcgccugccccaaguacgugaagcagaacacccugaagcucgccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccucgagaaguacguggaggacaccaagaucgaccuguggagcuacaacgcggagcugcucgucgcccuggagaaccagcacaccaucgaccugaccgacuccgagaugaacaagcuguucgagaagacgcggcgccagcugcgggagaacgccgaggacauggggaacggcugcuucaagaucuaccacaagugcgacaacgccugcaucgagagcauccgcaacggcaccuacgaccacgacguguaccgcgacgaggcccugaacaaccgguuccagaucaagggggucgagcucaaguccggcuacaaggacuggauccuguggaucagcuucgcgaucuccugcuuccugcucugcguggugcugcugggguucaucaugugggccugccagcgcggcaacauccggugcaacaucugcaucuga

SEQ ID NO: 62648 - RNA, 1701 nt, Artificial Sequence
  derived and/or modified sequence opt1 from hemagglutinin__InfluenzaA__ABO52368
augaagaccaucaucgcccugagcuacaucuucugccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagagcuccagcaccggcaagaucugcaacaacccccaccgcauccuggacgggaucaacugcacccugaucgacgcccuccugggcgacccccacugcgacgucuuccaggacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagagcggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 62649 - RNA, 1701 nt, Artificial Sequence
  derived and/or modified sequence opt1 from hemagglutinin__InfluenzaA__ABO52797
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggagcuacaucgccgagacccccaacagcgagaacgggaccugcuaccccggcuacuucgccgacuacgaggagcugcgcgagcagcuguccagcguguccagcuucgagcgguucgagaucuuccccaaggaguccagcuggccgaaccacaacgucaccaagggggugacggccuccugcagccacaagggcaaguccagcuucuaccgcaaccuccuguggcugaccgagaagaacggguccuaccccagccucagcaaguccuacgugaacaacaaggagaaggagguccuggugcuguggggcgugcaccaccccagcaacaucaaggaccagaagaccaucuaccggaaggagaacgccuacgucuccguggugagcucccacuacaaccgccgguucacccccgagaucgcgaagcgcccgaagguccgggaccaggaggggcgcaucaacuacuacuggacgcuccuggagcccggcgacaccaucaucuucgaggccaacggcaaccugaucgcccccugguacgccuucgcccucagccggggguucggcuccgggaucaucaccagcaacgcguccauggacgagugcgacgccaagugccagacgccccagggcgccaucaacagcucccugccguuccagaacgugcaccccgugaccaucggcgagugccccaaguacguccgcagcaccaagcugcggauggugaccgggcuccgcaacauccccuccauccagagccggggccuguucggggccaucgccggcuucaucgagggcggcuggaccggcaugaucgacgggugguacggcuaccaccaccagaacgagcagggguccggcuacgcggccgaccagaaguccacgcagagcgccaucaacgggaucaccaacaaggugaacagcaucaucgagaagaugaacacccaguucaccgccgucggcaaggaguucaacaagcuggagaagcgcauggagaaccucaacaagaagguggacgacggcuuccuggacaucuggacguacaacgccgagcugcucgugcugcuggagaacgagcggacccucgacuuccacgacuccaacgucaagaaccuguacgagaaggucaagagccagcugaagaacaacgcgaaggagaucgggaacggcugcuucgaguucuaccacaagugcaacaacgagugcauggagagcgugaagaacgggaccuacgacuacccgaaguacuccgaggagagcaagcucaaccgcgagaagaucgacggcgugaagcuggaguccauggggguguaccagauccuggccaucuacagcaccgucgccuccagccucgugcugcuggugucccucggcgccaucagcuucuggaugugcuccaacggcagccugcagugccggaucugcaucuga

SEQ ID NO: 62650 - RNA, 1698 nt, Artificial Sequence; identical to SEQ ID NO: 61750
  derived and/or modified sequence opt1 from hemagglutinin__InfluenzaA__ABP49217

SEQ ID NO: 62651 - RNA, 1698 nt, Artificial Sequence
  derived and/or modified sequence opt1 from hemagglutinin__InfluenzaA__ABP49305
augaaggccaagcugauggugcuccugugcaccuucaccgccacguacgcggacaccaucugcaucggcuaccacgccaacaacagcaccgacaccgucgacacggugcuggagaagaacgugaccgucacccacuccgugaaccuccuggaggacagccacaacgggaagcugugccuccugaagggcaucgcgccccugcagcucgggaacugcuccguggccggcuggauccuggggaacccggagugcgagcugcucaucagcaaggaguccuggagcuacaucgucgagacccccaaccccgagaacggcacgugcuaccccggcuacuucgccgacuacgaggagcugcgcgagcagcuguccagcguguccagcuucgagcgguucgagaucuucccgaaggaguccagcuggcccaaccacaccgugaccggggucuccgccagcugcucccacaacggcaagagcuccuucuaccgcaaccuccuguggcugaccgggaagaacggccucuaccccaaccugagcaaguccuacgccaacaacaaggagaaggaggugcuggugcucuggggcguccaccacccgcccaacaucggggaccagcgggcccuguaccacacggagaacgccuacgugagcguggucagcucccacuacagccgccgguucacccccgagaucgcgaagcgccccaaggugcgggaccaggagggccgcaucaacuacuacuggacccugcucgagcccggggacaccaucaucuucgaggccaacggcaaccugaucgccccgugguacgccuucgcccugucccggggguucggcagcggcaucaucacguccaacgcgcccaugggggagugcgacgccaagugccagacgccccagggcgccaucaacagcucccuccccuuccagaacgugcacccggucaccaucggggagugccccaaguacgugcgcagcgccaagcugcggauggugaccggccugcgcaacauccccuccauccagagccggggccucuucggggccaucgcgggcuucaucgagggcggguggaccgggauggucgacggcugguacggguaccaccaccagaacgagcagggcuccggcuacgccgccgaccagaaguccacccagaacgccaucaacgggaucaccaacaaggugaacagcgugaucgagaagaugaacacccaguucacggccgucggcaaggaguucaacaagcuggagcgccggauggagaaccugaacaagaagguggacgacggguuccucgacaucuggaccuacaacgcggagcugcugguccuccuggagaacgagcgcacccuggacuuccacgacagcaacgugaagaaccucuacgagaaggugaagucccagcugaagaacaacgccaaggagaucggcaacgggugcuucgaguucuaccacaagugcaacaacgagugcauggagagcgucaagaacggcaccuacgacuaccccaaguacuccgaggagagcaagcugaaccgggagaagaucgacggcgugaagcucgaguccauggggguguaccagauccuggccaucuacagcacggucgccagcucccuggugcuccuggugagccugggcgccaucuccuucuggaugugcagcaacgggucccuccagugccgcaucugcaucuga

SEQ ID NO: 62652 - RNA, 1701 nt, Artificial Sequence
  derived and/or modified sequence opt1 from hemagglutinin__InfluenzaA__ABP49316
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcaacaucgccggcuggauccuggggaacccggagugcgagagccucuucuccaagaaguccuggagcuacaucgccgagacccccaacagcgagaacgggaccugcuaccccggcuacuucgccgacuacgaggagcugcgggagcagcuguccagcguguccagcuucgagcgcuucgagaucuuccccaaggagcgguccuggccgaagcacaacaucacccgcggcgucacggccgccugcagccacaagggcaaguccagcuucuaccggaaccuccuguggcugaccgagaagaacggguccuaccccaaccucaagaaguccuacgugaacaacaaggagaaggaggugcugguccuguggggcgugcaccaccccagcaacaucgaggaccagaagacccucuaccgcaaggagaacgcguacgugagcgucgugagcuccaacuacaacaagcgguucacccccgagaucgccgagcgcccgaaggugcgggggcaggccggccgcaucaacuacuacuggacgcugcuggagcccggcgacaccaucaucuucgaggccaacgggaaccucaucgcccccuggcacgcguucgcccugagccggggcuucggguccggcaucaucaccagcaacgccuccauggacgagugcgacaccaagugccagacgccccagggcgccaucaacagcucccugccguuccagaacauccaccccgucaccaucggggagugccccaaguacgugcgcagcaccaagcuccggauggugaccggccugcgcaacauccccuccauccagagccgggggcuguucggcgccaucgcgggguucaucgagggcggcuggacggggaugaucgacggcugguacggguaccaccaccagaacgagcagggcuccggguacgccgccgaccagaaguccacccagaacgccaucaacggcaucaccaacaaggucaacagcgugaucgagaagaugaacacccaguucacggccgugggcaaggaguucaacaagcucgagaagcgcauggagaaccugaacaagaaggucgacgacggguuccuggacaucuggaccuacaacgcggagcuccuggugcugcucgagaacgagcggacccuggacuuccacgacagcaacgugaagaaccuguacgagaaggucaagucccagcucaagaacaacgccaaggagaucggcaacgggugcuucgaguucuaccacaagugcaacaacgagugcauggagagcgugaagaacggcaccuacgacuacccgaaguacuccgaggagagcaagcugaaccgcgagaagaucgacggggucaagcuggaguccaugggcguguaccagauccucgccaucuacagcacgguggccagcucccugguccugcucgugagccugggcgccaucuccuucuggaugugcagcaacgggucccugcagugccggaucugcaucuga

SEQ ID NO: 62653 - RNA, 1701 nt, Artificial Sequence
  derived and/or modified sequence opt1 from hemagglutinin__InfluenzaA__ABP49327
augaaggcccgccugcucgugcugcugugcgcccucgcggccaccgacgccgacaccaucugcaucggcuaccacgccaacaacagcacggacaccgucgacaccgugcuggagaagaacgugaccgucacgcacuccgugaaccugcucgaggacagccacaacgggaagcugugccggcugaagggcaucgcgccccuccagcugcgcaagugcaacaucgccggguggauccugggcaacccggagugcgagucccuccugagcgagcgguccuggagcuacaucguggagacccccaacuccgagaacgggaccugcuaccccggcgacuucaccaacuacgaggagcugcgcgagcagcucagcuccgucagcuccuucgagcgguucgagaucuuccccaaggagagcuccuggccgaagcacaacacgacccgcggcgugaccgccgccugcagccacgccgggaaguccagcuucuaccggaaccugcuguggcucaccgagaaggacggcuccuaccccaaccugaacaacagcuacgugaacaagaaggggaaggagguccuggugcucuggggcgugcaccaccccuccaacaucaaggaccagcagacgcuguaccagaaggagaacgcguacgucagcguggugagcuccaacuacaaccgccgguucacccccgagaucgccgagcgcccgaagguccgggggcaggccggccgcaugaacuacuacuggacccugcucaagcccggcgacaccaucauguucgaggccaacgggaaccugaucgcccccugguacgcguucgcccugagccggggcuucggguccggcaucaucacgagcaacgccuccaugcacgagugcgacaccaagugccagacgccccagggcgccaucaacagcucccucccguuccagaacauccaccccgugaccaucggggagugccccaaguacgugcgcagcaccaagcugcggauggucaccggccugcgcaacauccccuccauccagagccggggccucuucggggccaucgcgggguucaucgagggcggcuggaccgggaugaucgacggcugguacggguaccaccaccagaacgagcagggcuccggguacgccgccgaccagaaguccacccagaacgccaucaacggcaucacgaacaaggugaacagcgugaucgagaagaugaacacccaguucaccgccgucggcaaggaguucaacaaccuggagaagcgcauggagaaccugaacaagaagguggacgacggguuccucgacaucuggaccuacaacgcggagcugcugauccuccuggagaacgagcggacgcuggacuuccacgacagcaacgugaagaaccucuacgagaaggucaagucccagcugcgcaacaacgccaaggagaucggcaacgggugcuucgaguucuaccacaagugcaacaacgagugcauggagagcgugaagaacggcaccuacgacuacccgaaguacuccgaggagagcaagcugaaccgggagaagaucgacggggucaagcucgaguccaugggcguguaccagauccuggccaucuacagcaccguggccagcucccugguccuccuggugagccugggcgccaucuccuucuggaugugcagcaacgggucccuccagugccgcaucugcaucuga

SEQ ID NO: 62654 - RNA, 1701 nt, Artificial Sequence
  derived and/or modified sequence opt1 from hemagglutinin__InfluenzaA__ABP49338
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagcggagcuggccgaagcacaacgucacccgcggcgugacggccuccugcagccacaagggcaaguccagcuucuaccggaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccgcaaggagaacgccuacgucagcgugguguccagcaacuacaaccggcgcuucacccccgagaucgcgaagcggccgaagguccgcgggcaggagggccggaucaacuacuacuggacgcuccuggagcccggcgacaccaucaucuucgaggccaacgggaaccugaucgcccccugguacgccuucgcccucucccgcggcuucgggagcggcaucaucaccuccaacgcgagcauggacgagugcgacaccaagugccagacgccccagggcgccaucaacuccagccugccguuccagaacgugcaccccgugaccaucggggagugccccaaguacguccgguccaccaagcugcgcauggugaccggccuccggaacauccccagcauccagucccgcgggcuguucggcgccaucgccggguucaucgagggcggcuggacggggaugaucgacggcugguacggguaccaccaccagaacgagcagggcagcggguacgccgcggaccagaaguccacccagaacgccaucaacggcaucaccaacaaggugaacagcgucaucgagaagaugaacacccaguucacggccgugggcaaggaguucaacaagcuggagaagcggauggagaaccucaacaagaagguggacgacggguuccuggacaucuggaccuacaacgccgagcugcucguccugcuggagaacgagcgcacccucgacuuccacgacuccaacgugaagaaccuguacgagaaggucaagagccagcugaagaacaacgccaaggagaucggcaacgggugcuucgaguucuaccacaagugcaacaacgagugcauggaguccgugaagaacggcaccuacgacuacccgaaguacagcgaggagagcaagcucaaccgggagaagaucgacggggugaagcuggaguccaugggcgucuaccagauccuggcgaucuacagcacgguggccuccagccucgugcugcuggucucccucggcgccaucagcuucuggaugugcuccaacgggagccugcagugccgcaucugcaucuga

SEQ ID NO: 62655 - RNA, 1701 nt, Artificial Sequence
  derived and/or modified sequence opt1 from hemagglutinin__InfluenzaA__ABP49349
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacaaccacaacgggaagcugugcaagcugaagggcaucgcgccccuccagcuggggaagugcuccaucgccggcuggauccuggggaacccggagugcgagagccucuucuccaagaaguccuggagcuacaucgccgagacccccaacagcgagaacgggaccugcuaccccggcuacuucgccgacuacgaggagcugcgcgagcagcuguccagcguguccagcuucgagcgguucgagaucuuccccaaggaguccagcuggccgaaccacaacgucaccaagggggugacggccuccugcagccacaagggcaaguccagcuucuaccgcaaccuccuguggcugaccgagaagaacggguccuaccccaaccucagcaagagcuacgugaacaacaaggagaaggagguccuggugcuguggggcauccaccaccccuccaacaucgaggaccagaagaccaucuaccggaaggagaacgccuacgugagcgucguguccagccacuacaaccgccgguucacccccgagaucgcgaagcgcccgaaggugcgggaccaggaggggcgcaucaacuacuacuggacgcuccuggagcccggcgacaccaucaucuucgaggccaacggcaaccugaucgcccccugguacgccuucgcccucucccggggguucggcagcgggaucaucaccuccaacgcgagcauggacgagugcgacgccaagugccagacgccccugggcgccaucaacuccagccugccguuccagaacguccaccccgugaccaucggcgagugccccaaguacgugcgcuccaccaagcuccggauggucaccgggcugcgcaacauccccagcauccagucccggggccuguucggggccaucgccggcuucaucgagggcggcuggaccggcaugaucgacgggugguacggcuaccaccaccagaacgagcaggggagcggcuacgcggccgaccagaaguccacgcagagcgccaucaacgggaucaccaacaaggugaacuccaucaucgagaagaugaacacccaguucaccgccgugggcaaggaguucaacaagcucgagaagcgcauggagaaccugaacaagaaggucgacgacggcuuccuggacaucuggacguacaacgccgagcuccuggugcugcucgagaacgagcggacccuggacuuccacgacagcaacgugaagaaccuguacgagaaggucaagucccagcucaagaacaacgcgaaggagaucgggaacggcugcuucgaguucuaccacaagugcaacaacgagugcauggagagcgugaagaacgggaccuacgacuacccgaaguacagcgaggaguccaagcugaaccgcgagaagaucgacggcgucaagcuggagagcauggggguguaccagauccucgccaucuacuccaccguggccagcucccugguccugcucgugagccugggcgccaucuccuucuggaugugcagcaacggcucccugcagugccggaucugcaucuga

SEQ ID NO: 62656 - RNA, 1701 nt, Artificial Sequence
  derived and/or modified sequence opt1 from hemagglutinin__InfluenzaA__ABP49360
augaaggccaagcugcucauccugcugugcgccuucaccgcgaccgacgccgacacgaucugcaucggcuaccacgccaacaacagcaccgacaccguggacaccguccucgagaagaacgugacggugacccacuccgucaaccugcuggaggacagccacaacgggaagcucugccgccugaagggcaucgcgccccugcagcucgggaacugcuccaucgccggcuggauccuggggaacccggagugcgagagccuguucuccaagaaguccuggagcuacaucgccgagacccccaacagcgagaacgggaccugcuaccccggcuacuucgccgacuacgaggagcuccgggagcagcuguccagcguguccagcuucgagcgcuucgagaucuuccccaaggaguccagcuggccgaaccacacggugaccaagggggucaccgccuccugcagccacaacggcaaguccagcuucuaccggaaccugcucuggcugaccaagaagaacggguccuaccccaaccugagcaagagcuacgugaacaacaaggagaaggaggugcucguccuguggggcgugcaccaccccuccaacaucggggaccagcgcgccaucuaccacacggagaacgcguacgugagcgucguguccagccacuacaaccggcgcuucacccccgagaucgccaagcggccgaaggugcgcgaccaggagggccggaucaacuacuacuggacccugcucgagcccggcgacaccaucaucuucgaggccaacgggaaccugaucgcccccugguacgccuucgcgcugucccgcggcuucgggagcggcaucaucacguccaacgccagcauggacgagugcgacgccaagugccagacgccccagggcgccaucaacuccagccucccguuccagaacguccaccccgugaccaucggggagugccccaaguacgugcgguccaccaagcugcgcauggucaccggccugcggaacauccccagcauccagucccgcggccucuucggcgccaucgcgggguucaucgagggcggcuggaccgggaugaucgacggcugguacggguaccaccaccagaacgagcagggcagcggguacgccgccgaccagaaguccacccagaacgccaucaacggcaucaccaacaaggugaacagcgugaucgagaagaugaacacgcaguucaccgccgucggcaaggaguucaacaagcuggagcggcgcauggagaaccugaacaagaagguggacgacggguuccucgacaucuggaccuacaacgcggagcugcuggugcuccuggagaacgagcggacccuggacuuccacgacuccaacgucaagaaccucuacgagaaggucaagagccagcugaagaacaacgccaaggagaucggcaacgggugcuucgaguucuaccacaagugcaacaacgagugcauggaguccgugaagaacggcacguacgacuacccgaaguacagcgaggagagcaagcugaaccgcgagaagaucgacggggugaagcucgaguccaugggcguguaccagauccuggccaucuacagcaccgucgccuccagccuggugcuccuggugucccugggcgccaucagcuucuggaugugcuccaacgggagccuccagugccggaucugcaucuga

SEQ ID NO: 62657 - RNA, 1701 nt, Artificial Sequence; identical to SEQ ID NO: 61658
  derived and/or modified sequence opt1 from hemagglutinin__InfluenzaA__ABP49371

SEQ ID NO: 62658 - RNA, 1701 nt, Artificial Sequence; identical to SEQ ID NO: 62395
  derived and/or modified sequence opt1 from hemagglutinin__InfluenzaA__ABP49382

SEQ ID NO: 62659 - RNA, 1698 nt, Artificial Sequence
  derived and/or modified sequence opt1 from hemagglutinin__InfluenzaA__ABP49393
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccugugggggauccaccacccgcccaacaucggcgaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacccagaacgccaucaacggcaucaccaacaaggugaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcucaaccgcgagcggaucgacggcgugaagcuggaguccaugggcguguaccagauccuggccaucuacagcacggucgccagcucccucgugcugcuggugagccucggggccaucuccuucuggaugugcagcaacggcucccugcagugccgcaucugcaucuga

SEQ ID NO: 62660 - RNA, 1701 nt, Artificial Sequence
  derived and/or modified sequence opt1 from hemagglutinin__InfluenzaA__ABP49404
augaagaccaucaucgcccugagcuacacccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagagcuccagcaccgggggcaucugcgacagcccccaccagauccucgacggggagaacugcacgcugaucggcgcccugcucggcgacccccagugcgacggguuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggaccggggugacccagaacggcacguccagcgccugcaagcgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccuacaacgaccagaucagccuguacgcgcaggccuccggccggaucacggugagcaccaagcgcagccagcagaccgugaucccgaacaucgggucccggccccgcguccgggacauccccagccgcaucuccaucuacuggaccaucgugaagcccggcgacauccugcucaucaacagcacggggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggcuucaucgagaacgggugggagggcaugguggacgggugguacggcuuccgccaccagaacuccgaggggaucggccaggccgccgaccugaaguccacccaggcggccaucaaccagaucaacggcaagcugaaccggcucaucgggaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcacguacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggccugccagaaggggaacauccggugcaacaucugcaucuga

SEQ ID NO: 62661 - RNA, 1701 nt, Artificial Sequence; identical to SEQ ID NO: 61658
  derived and/or modified sequence opt1 from hemagglutinin__InfluenzaA__ABP49415

SEQ ID NO: 62662 - RNA, 1701 nt, Artificial Sequence; identical to SEQ ID NO: 61658
  derived and/or modified sequence opt1 from hemagglutinin__InfluenzaA__ABP49426

SEQ ID NO: 62663 - RNA, 1689 nt, Artificial Sequence
  derived and/or modified sequence opt1 from hemagglutinin__InfluenzaA__ABP49437
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgagaucgccacgcggcccaaggugaacggccucggcgggcgcauggaguucagcuggacccugcuggacaugugggacaccaucaacuucgaguccaccggcaaccucaucgcccccgaguacggguucaagaucagcaagcggggcuccagcgggaucaugaagacggagggcacccuggagaacugcgagaccaagugccagaccccgcugggcgccaucaacacgacccuccccuuccacaacgugcacccccugaccaucggggagugccccaaguacgucaagagcgagaagcuggugcucgcgaccggccugcgcaacgugccgcagaucgagucccgggggcuguucggcgccaucgccggguucaucgagggcggcuggcaggggauggucgacggcugguacggguaccaccacagcaacgaccagggcuccggguacgccgccgacaaggagagcacgcagaaggcguucgacggcaucaccaacaaggugaacuccgugaucgagaagaugaacacccaguucgaggccgucggcaaggaguucagcaaccucgagcgccggcuggagaaccugaacaagaagauggaggacggguuccucgacguguggaccuacaacgccgagcugcuggugcucauggagaacgagcgcacgcuggacuuccacgacuccaacgucaagaaccuguacgacaaggugcggaugcagcuccgcgacaacgucaaggagcugggcaacgggugcuucgaguucuaccacaagugcgacgacgagugcaugaacagcgugaagaacggcaccuacgacuaccccaaguacgaggaggaguccaagcugaaccggaacgagaucaagggcgugaagcucagcuccaugggggucuaccagauccuggccaucuacgccaccguggcgggcagccugucccucgccaucaugauggccgggaucagcuucuggaugugcuccaacggcagccugcagugccgcaucugcaucuga

SEQ ID NO: 62664 - RNA, 1701 nt, Artificial Sequence
  derived and/or modified sequence opt1 from hemagglutinin__InfluenzaA__ABP49448
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagcggagcuggccgaagcacaacgucacccgcggcgugacggccuccugcagccacaagggcaaguccagcuucuaccggaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccgcaaggagaacgccuacgucagcgugguguccagcaacuacaaccggcgcuucacccccgagaucuccgagcggccgaagguccgcgggcaggagggccggaucaacuacuacuggacgcuccuggagcccggcgacaccaucaucuucgaggcgaacgggaaccugaucgcccccugguacgccuucgcccucagccgcggcuucggguccggcaucaucaccagcaacgccuccauggacgagugcgacaccaagugccagacgccccagggcgcgaucaacagcucccugccguuccagaacgugcaccccgugaccaucggggagugccccaaguacguccggagcaccaagcugcgcauggugaccggccuccggaacauccccuccauccagagccgcgggcuguucggcgccaucgccggguucaucgagggcggcuggacggggaugaucgacggcugguacggguaccaccaccagaacgagcagggcuccggguacgccgccgaccagaaguccacccagaacgcgaucaacggcaucaccaacaaggugaacagcgucaucgagaagaugaacacccaguucacggccgugggcaaggaguucaacaagcuggagaagcggauggagaaccucaacaagaagguggacgacggguuccuggacaucuggaccuacaacgccgagcugcucguccugcuggagaacgagcgcacccucgacuuccacgacagcaacgugaagaaccuguacgagaaggucaagucccagcugaagaacaacgccaaggagaucggcaacgggugcuucgaguucuaccacaagugcaacaacgagugcauggagagcgugaagaacggcaccuacgacuacccgaaguacagcgaggaguccaagcucaaccgggagaagaucgacggggugaagcuggagagcaugggcgucuaccagauccuggccaucuacuccacgguggcgagcucccucgugcugcuggucagccucggcgccaucuccuucuggaugugcagcaacgggucccugcagugccgcaucugcaucuga

SEQ ID NO: 62665 - RNA, 1689 nt, Artificial Sequence
  derived and/or modified sequence opt1 from hemagglutinin__InfluenzaA__ABP49459
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucgggacccccacccugaacaagcgcagcacccccgacaucgccacgcggcccaaggugaacggccagggcgggcgcauggaguucuccuggacccuccuggacaugugggacaccaucaacuucgagagcaccggcaaccugaucgccccggaguacggguucaagaucuccaagcggggcagcuccgggaucaugaagacggagggcacccucggcaacugcgagaccaagugccagacgccccugggggccaucaacaccacccugcccuuccacaacgugcacccccucaccaucggcgagugcccgaaguacgucaagagcgagaagcuggugcuggcgaccgggcuccgcaacgugccccagaucgagagccggggccuguucggggccaucgccggcuucaucgagggcggguggcagggcauggucgacgggugguacggcuaccaccacuccaacgaccaggggagcggcuacgccgccgacaaggaguccacgcagaaggcguucgacggcaucaccaacaaggugaacagcgugaucgagaagaugaacacccaguucgaggccgucgggaaggaguucuccaaccuggagcgccggcucgagaaccugaacaagaagauggaggacggcuuccuggacguguggaccuacaacgccgagcuccuggugcugauggagaacgagcgcacgcucgacuuccacgacagcaacgucaagaaccuguacgacaaggugcggaugcagcugcgcgacaacgucaaggagcucgggaacggcugcuucgaguucuaccacaagugcgacgacgagugcaugaacuccgugaagaacggcaccuacgacuaccccaaguacgaggaggagagcaagcugaaccggaacgagaucaagggggugaagcuguccagcaugggcgucuaccagauccucgccaucuacgccaccguggcggggucccugagccuggccaucaugauggccggcaucuccuucuggaugugcagcaacgggucccuccagugccgcaucugcaucuga

SEQ ID NO: 62666 - RNA, 1689 nt, Artificial Sequence
  derived and/or modified sequence opt1 from hemagglutinin__InfluenzaA__ABP49470
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucagcaccuccacccugaacaagcgcagcacccccgacaucgccacgcggcccaaggugaacgggcucggcggccgcauggaguucuccuggacccugcuggacaugugggacaccaucaacuucgagagcaccgggaaccucaucgcccccgaguacggcuucaagaucuccaagcgggggagcagcggcaucaugaagacggaggggacccugggcaacugcgagaccaagugccagaccccgcugggcgccaucaacacgacccuccccuuccacaacgugcacccccugaccaucggggagugccccaaguacgucaaguccgagaagcuggugcucgcgaccggccugcgcaacgugccgcagaucgagagccgggggcuguucggcgccaucgccggguucaucgagggcggcuggcaggggauggucgacggcugguacggguaccaccacuccaacgaccagggcagcggguacgccgccgacaaggaguccacgcagaaggcguucgacggcaucaccaacaaggugaacagcgugaucgagaagaugaacacccaguucgaggccgucggcaaggaguucuccaaccucgagcgccggcuggagaaccugaacaagaagauggaggacggguuccucgacguguggaccuacaacgccgagcugcuggugcucauggagaacgagcgcacgcuggacuuccacgacagcaacgucaagaaccuguacgacaaggugcggaugcagcuccgcgacaacgucaaggagcugggcaacgggugcuucgaguucuaccacaagugcgacgacgagugcaugaacuccgugaagaacggcaccuacgacuaccccaaguacgaggaggagagcaagcugaaccggaacgagaucaagggcgugaagcucuccagcaugggggucuaccagauccuggccaucuacgccaccguggcgggcucccugagccucgccaucaugauggccgggaucuccuucuggaugugcagcaacggcucccugcagugccgcaucugcaucuga

SEQ ID NO: 62667 - RNA, 1701 nt, Artificial Sequence
  derived and/or modified sequence opt1 from hemagglutinin__InfluenzaA__ABP49492
augaagaccaucaucgcccugagcuacaucuucugccucguguucgcccagggccugcccgggaacgacaacuccaccgcgacgcugugccucggccaccacgccgucccgaacgggacccuggugaagaccaucaccaacgaccagaucgaggugacgaacgccaccgagcugguccagagcuccagcaccggcaagaucugcgacaacccccaccgcauccucgacgggaucaacugcacccugaucgacgcccugcucggcgacccccacugcgacggcuuccagaacgagaagugggaccuguucguggagcgguccaaggccuucagcaacugcuaccccuacgacgugccggacuacgcgucccugcgcagccucgucgccuccagcgggacgcuggaguucaucaacgagggcuucaacuggaccggggugacccagaacggcggguccagcuccugcaagcggggccccgacaacggcuucuucagccgccugaacuggcucuacaaguccgggagcaccuaccccgugcagaacgucacgaugcccaacaacgacaacuccgacaagcuguacaucuggggcgugcaccacccgagcaccgacaaggagcagaccgaccuguacgugcaggccuccgggaaggucaccgugagcacgaagcggagccagcagaccgugauccccaacgucggcucccgccccugggugcggggccucagcucccgcgugagcaucuacuggaccaucgucaagcccggggacauccuggugaucaacuccaacggcaaccugaucgccccgcggggguacuucaagaugcgcaccggcaagagcuccaucaugcggagcgacgcgcccaucgggacgugcuccagcgagugcaucacccccaacggcuccauccccaacgacaagccguuccagaacgugaacaagaucaccuacggcgccugccccaaguacgucaagcagaacacccucaagcuggccacggggaugcgcaacgugcccgagaagcagacccggggcaucuucggggccaucgccggcuucaucgagaacgggugggagggcaugaucgacggcugguacggguuccgccaccagaacagcgagggcaccgggcaggcggccgaccugaaguccacccaggccgccaucgaccagaucaacggcaagcucaaccgggugaucgagaagacgaacgagaaguuccaccagaucgagaaggaguucagcgaggucgaggggcgcauccaggaccuggagaaguacguggaggacaccaagaucgaccugugguccuacaacgccgagcuccuggucgcgcuggagaaccagcacaccaucgaccucaccgacagcgagaugaacaagcuguucgagaagacgcggcgccagcugcgggagaacgccgaggacaugggcaacggcugcuucaagaucuaccacaagugcgacaacgccugcaucggguccauccgcaacggcaccuacgaccacgacguguaccgggacgaggcccucaacaaccgcuuccagaucaaggggguggagcucaagagcggcuacaaggacuggauccuguggaucuccuucgccaucagcugcuuccugcugugcgucgugcugcucggcuucaucaugugggcgugccagaaggggaacauccgcugcaacaucugcaucuga

SEQ ID NO: 62668 - RNA, 1701 nt, Artificial Sequence; identical to SEQ ID NO: 62564
  derived and/or modified sequence opt1 from hemagglutinin__InfluenzaA__ABP49503

SEQ ID NO: 62669 - RNA, 1701 nt, Artificial Sequence
  derived and/or modified sequence opt1 from hemagglutinin__InfluenzaA__ABP49514
augaagaccaucaucgcccugagcuacaucuucuaccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagagcggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 62670 - RNA, 1701 nt, Artificial Sequence
  derived and/or modified sequence opt1 from hemagglutinin__InfluenzaA__ABQ01311
augaaggcccgccugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccggcugaagggcaucgcgccccuccagcuggggaagugcaacaucgccggcuggauccuggggaacccggagugcgagagccuccuguccaaccgcagcugguccuacaucgccgagacccccaacagcgagaacgggaccugcuaccccggcgacuucgccgacuacgaggagcugcgggagcagcucuccagcguguccagcuucgagcgcuucgagaucuuccccaaggagcgguccuggccgaagcacaacaucacccgcggggugacggccgccugcagccacgcgaagaaguccagcuucuacaagaaccugcuguggcucaccgaggccaacggcuccuaccccaaccugagcaaguccuacgucaacaacaaggagaaggaggugcuggugcucuggggcguccaccaccccagcaagaucgaggaccagcggacccuguaccgcaaggagaacgccuacgugagcguggucuccagcaacuacaaccggcgcuucacccccgagaucgccgagcggccgaaggugcgcggccaggccgggcggaugaacuacuacuggacgcugcucgagcccggcgacaagaucaucuucgaggcgaacggcaaccugaucgcccccugguacgccuucgcccugucccgcgggcucggcagcgggaucaucaccuccaacgccagcauggacgagugcgacaccaagugccagacgccccagggcgcgaucaacuccagccugccguuccagaacauccaccccgugaccaucggcgagugccccaaguacguccgguccaccaagcugcgcauggugaccgggcuccggaacauccccagcauccagucccgcggccuguucggggccaucgccggcuucaucgagggcggguggaccggcaugguggacgggugguacggcuaccaccaccagaacgagcaggggagcggcuacgccgccgaccagaaguccacgcagaacgcgaucaacgggaucaccaacaaggucaacagcgugaucgagaagaugaacacccaguucaccgccgugggcaaggaguucaacaagcuggagaagcggauggagaaccucaacaagaaggucgacgacggcuuccuggacaucuggacguacaacgccgagcugcucgugcugcuggagaacgagcgcacccucgacuuccacgacuccaacgugaagaaccuguacgagaaggucaagaaccagcugcggaacaacgccaaggagaucgggaacggcugcuucgaguucuaccacaagugcgacaacgagugcauggagagcgugaagaacgggaccuacgacuacccgaaguacuccgaggagagcaagcucaaccgcgagaagaucgacggcgucaagcuggaguccauggggguguaccagauccuggccaucuacagcaccguggcgagcucccucguccugcuggugagccucggcgccaucuccuucuggaugugcagcaacggcucccugcagugccgcaucugcaucuga

SEQ ID NO: 62671 - RNA, 1701 nt, Artificial Sequence
  derived and/or modified sequence opt1 from hemagglutinin__InfluenzaA__ABQ01322
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccaccuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagcggagcuggccgaagcacaacgucacccgcggcgugacggccgccugcucccacaagggcaagagcuccuucuaccggaaccuccuguggcugaccgagaagaacgggagcuaccccaaccucuccaagagcuacgugaacaacaaggagaaggagguccuggugcuguggggcgugcaccaccccagcaacaucgaggaccagaagaccaucuaccgcaaggagaacgcguacgucuccguggugagcuccaacuacaaccggcgcuucacccccgagaucgccaagcggccgaagguccgcgggcaggagggccggaucaacuacuacuggacgcuccuggagcccggcgacaccaucaucuucgaggccaacgggaaccugaucgcccccugguacgccuucgcgcucagccgcggcuucggguccggcaucaucaccagcaacgccuccauggacgagugcgacgccaagugccagacgccccagggcgccaucaacagcucccugccguuccagaacgugcaccccgugaccaucggggagugccccaaguacguccggagcaccaagcugcgcauggugaccggccuccggaacauccccuccauccagagccgcgggcuguucggcgccaucgcgggguucaucgagggcggcuggaccgggaugaucgacggcugguacggguaccaccaccagaacgagcagggcuccggguacgccgccgaccagaaguccacgcagaacgccaucaacggcaucaccaacaaggugaacagcgucaucgagaagaugaacacccaguucaccgccgugggcaaggaguucaacaagcuggagaagcggauggagaaccucaacaagaagguggacgacggguuccuggacaucuggacguacaacgcggagcugcucguccugcuggagaacgagcgcacccucgacuuccacgacagcaacgugaagaaccuguacgagaaggucaagucccagcugaagaacaacgccaaggagaucggcaacgggugcuucgaguucuaccacaagugcaacaacgagugcauggagagcgugaagaacggcaccuacgacuacccgaaguacuccgaggagagcaagcucaaccgggagaagaucgacggggugaagcuggagagcaugggcgucuaccagauccuggccaucuacuccaccguggccagcucccucgugcugcuggucagccucggcgccaucuccuucuggaugugcagcaacgggucccugcagugccgcaucugcaucuga

SEQ ID NO: 62672 - RNA, 1701 nt, Artificial Sequence; identical to SEQ ID NO: 61658
  derived and/or modified sequence opt1 from hemagglutinin__InfluenzaA__ABQ01333

SEQ ID NO: 62673 - RNA, 1701 nt, Artificial Sequence
  derived and/or modified sequence opt1 from hemagglutinin__InfluenzaA__ABQ01344
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagccggaucuccaucuacuggacgaucgucaagcccggggacauccuccugaucaacugcaccggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacgcucaagcuggccaccgggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacgcaggccgccaucaaccagaucaacggcaagcucaaccgccugaucggcaagaccaacgagaaguuccaccagaucgagaaggaguucuccgagguggaggggcggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgcggaggacaugggcaacgggugcuucaagaucuaccacaagugcgacaacgccugcaucggcagcauccgcaacgggaccuacgaccacgacguguaccgcgacgaggcccugaacaaccgguuccagaucaagggcgucgagcugaaguccggcuacaaggacuggauccucuggaucagcuucgccaucagcugcuuccugcugugcgugguccuccugggguucaucaugugggccugccagaagggcaacauccgcugcaacaucugcaucuga

SEQ ID NO: 62674 - RNA, 1689 nt, Artificial Sequence
  derived and/or modified sequence opt1 from hemagglutinin__InfluenzaA__ABQ01355
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcgacggccucugcuacccgggguccuucaacgacuacgaggagcugaagcaccuccugagcuccgugaagcacuucgagaaggugcggauccugcccaaggaccgcuggacgcagcacaccaccaccggcgggagccgggccugcgccgucuccggcaaccccagcuucuuccgcaacaugaucuggcugacgaagaagggguccaacuaccccguggcgaagggcagcuacaacaacaccuccggcgagcagaugcucaucaucuggggcgugcaccacccgaucgacgagaccgagcagcggacccuguaccagaacgucgagacguacgugagcguggucaccuccacccugaacaagcgcagcacccccaagaucgccacgcggcccaaggugaacgggcucgggggccgcauggaguucuccuggacccugcuggacaugugggacaccaucaacuucgagagcaccggcaaccucaucgcccccgaguacggguucaagaucuccaagcggggcagcuccgggaucaugaagacggagggcacccuggagaacugcgagaccaagugccagaccccgcugggggccaucaacacgacccuccccuuccacaacgugcacccccugaccaucggcgagugccccaaguacgucaagagcgagaagcuggugcucgcgaccggccugcgcaacgugccgcagaucgagagccgggggcuguucggcgccaucgccggguucaucgagggcggguggcagggcauggucgacggcugguacggguaccaccacuccaacgaccagggcagcggguacgccgccgacaaggaguccacgcagcgcgcguucgacggcaucaccaacaaggugaacagcgugaucgagaagaugaacacccaguucgaggccgucgggaaggaguucuccaaccucgagcggcgccuggagaaccugaacaagaagauggaggacggcuuccucgacguguggaccuacaacgccgagcugcuggugcucauggagaacgagcggacgcuggacuuccacgacagcaacgucaagaaccuguacgacaaggugcgcaugcagcuccgggacaacgucaaggagcugggcaacgggugcuucgaguucuaccacaagugcgacgacgagugcaugaacuccgugaagaacggcaccuacgacuaccccaaguacgaggaggagagcaagcugaaccgcaacgagaucaagggggugaagcucuccagcaugggcgucuaccagauccuggccaucuacgccaccguggcgggcucccugagccucgccaucaugauggccgggaucuccuucuggaugugcagcaacggcucccugcagugccgcaucugcaucuga

SEQ ID NO: 62675 - RNA, 1701 nt, Artificial Sequence
  derived and/or modified sequence opt1 from hemagglutinin__InfluenzaA__ABQ01366
augaagaccaucaucgcccugagcuacaucuucugccucguguucgcccaggaccugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgugccggacuacgcgucccugcgcagccucgucgccuccagcggcacgcuggaguucaucaacgagggguucaacuggaccggcgugacccagaacgggggcuccagcgccugcaagcgggggcccgacaacggcuucuucucccgccugaacuggcucuacaagagcggcuccaccuaccccgugcagaacgucacgaugaccaacaacgacaacagcgacaagcuguacaucuggggcgugcaccaccccuccaccgacaaggagcagaccgaccuguacgugcaggccagcggcaaggucacgguguccaccaagcggagccagcagaccaucaucccgaacguggggagccgccccuggguccggggccucuccagccgcguguccaucuacuggaccaucgugaagcccggcgacauccuggucaucaacagcaacgggaaccugaucgcgccccggggcuacuucaagaugcgcacggggaaguccagcaucaugcgguccgacgccccgaucgggaccugcagcuccgagugcaucacccccaacgggagcauccccaacgacaagcccuuccagaacgugaacaagaucaccuacggcgccugcccgaaguacgugaagcagaacacgcucaagcuggccaccggcaugcgcaacguccccgagaagcagacccgggggaucuucggcgccaucgcgggguucaucgagaacggcugggaggggaugaucgacggcugguacggcuuccgccaccagaacuccgaggggaccggccaggccgccgaccucaagagcacgcaggccgccaucgaccagaucaacgggaagcugaaccgggugaucgagaagaccaacgagaaguuccaccagaucgagaaggaguucuccgagguggagggccgcauccaggaccuggagaaguacgucgaggacaccaagaucgaccuguggagcuacaacgcggagcuccugguggcccuggagaaccagcacaccaucgaccucacggacuccgagaugaacaagcuguucgagaagacccggcgccagcugcgggagaacgccgaggacauggggaacggcugcuucaagaucuaccacaagugcgacaacgccugcaucggcagcauccgcaacgggaccuacgaccacgacgucuaccgggacgaggcccucaacaaccgcuuccagaucaagggcguggagcugaaguccggguacaaggacuggauccuguggaucagcuucgcgaucuccugcuuccuccugugcgugguccugcucggcuucaucaugugggccugccagaagggcaacauccgcugcaacaucugcaucuga

SEQ ID NO: 62676 - RNA, 1701 nt, Artificial Sequence; identical to SEQ ID NO: 62441
  derived and/or modified sequence opt1 from hemagglutinin__InfluenzaA__ABQ44383

SEQ ID NO: 62677 - RNA, 1701 nt, Artificial Sequence; identical to SEQ ID NO: 61641
  derived and/or modified sequence opt1 from hemagglutinin__InfluenzaA__ABQ44405

SEQ ID NO: 62678 - RNA, 1701 nt, Artificial Sequence
  derived and/or modified sequence opt1 from hemagglutinin__InfluenzaA__ABQ44416
augaaggccaagcugcucgugcugcugugcgccuucaccgcgaccgacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggagcuacaucgccgagacccccaacagcgagaacgggaccugcuaccccggcuacuucgccgacuacgaggagcuccgggagcagcuguccagcguguccagcuucgagcgcuucgagaucuuccccaaggaguccagcuggccgaaccacacggucaccaagggggugaccgccuccugcagccacaagggcaaguccagcuucuaccggaaccugcucuggcugaccgagaagaacggguccuaccccaaccugagcaagagcuacgugaacaacaaggagaaggagguccucgugcuguggggcgugcaccaccccuccaacaucggggaccagcgcgccaucuaccacacggagaacgcguacgucagcgugguguccagccacuacaaccggcgcuucacccccgagaucgccaagcggccgaagguccgcgaccaggagggccggaucaacuacuacuggacccugcucgagcccgaggacaccaucaucuucgaggccaacggcaaccugaucgcccccugguacgccuucgcgcugucccgcggguucggcagcgggaucaucacguccaacgccagcauggacgagugcgacgccaagugccagacgccccagggcgccaucaacuccagccucccguuccagaacgugcaccccgugaccaucggcgagugccccaaguacguccgguccaccaagcugcgcauggugaccgggcugcggaacauccccagcauccagucccgcggccucuucggggccaucgcgggcuucaucgagggcggcuggaccggcaugaucgacgggugguacggcuaccaccaccagaacgagcaggggagcggcuacgccgccgaccagaaguccacccagaacgccaucaacgggaucaccaacaaggugaacagcgucaucgagaagaugaacacgcaguucaccgccgugggcaaggaguucaacaagcuggagcggcgcauggagaaccugaacaagaagguggacgacggcuuccucgacaucuggaccuacaacgcggagcugcugguccuccuggagaacgagcggacccuggacuuccacgacuccaacgugaagaaccucuacgagaaggucaagagccagcugaagaacaacgccaaggagaucgggaacggcugcuucgaguucuaccacaagugcaacaacgagugcauggaguccgugaagaacgggacguacgacuacccgaaguacagcgaggagagcaagcugaaccgcgagaagaucgacggcgugaagcucgaguccaugggggucuaccagauccuggccaucuacagcaccguggccuccagccuggugcuccuggucucccugggcgccaucagcuucuggaugugcuccaacggcagccuccagugccggaucugcaucuga

SEQ ID NO: 62679 - RNA, 1701 nt, Artificial Sequence; identical to SEQ ID NO: 61264
  derived and/or modified sequence opt1 from hemagglutinin__InfluenzaA__ABQ44427

SEQ ID NO: 62680 - RNA, 1689 nt, Artificial Sequence
  derived and/or modified sequence opt1 from hemagglutinin__InfluenzaA__ABQ44438
auggccaucaucuacuucauccugcuguucaccgccgugcgcggcgaccagaucugcaucggguaccacgcgaacaacagcaccgagaaggucgacacgauccuggagcggaacgugaccgugacccacgccaaggacauccuggagaagacccacaacggcaagcucugcaagcugaacgggaucccgccccuggagcucggcgacugcuccaucacgggguggcugcugggcaaccccgagugcgaccgccuccugcggguccccgaguggagcuacaucauggagaaggagaacccccgcuacucccugugcuacccgggcagcuucaacgacuacgaggagcucaagcaccuccuguccagcgugaagcacuucgagaaggugcggauccuccccaaggacggguggacccagcacaccaccuccggcgggagcaaggccugcgccgucuccggcaagagcuccuucuuccgcaacaugguguggcugacgaagaaggggcccaacuaccccguggccaagcggagcuacaacaacaccuccggcgagcagaugcugaucaucuggggcguccaccacccgaacgacgaggcggagcagagcgcccucuaccagaagguggggaccuacguguccgccagcaccuccacgcugaacaagcgcagcacccccgagaucgccgcgcggcccgaggucaacggccuggggucccgcauggaguucagcuggacccuccuggacgugugggacaccaucaacuucgagagcacgggcaaccugguggcccccgaguacggcuucaagaucuccaagcgggggagcuccggcaucaugaagaccgaggggacccucggcaacugcgagaccaagugccagacgccgcugggggccaucaacaccacccugcccuuccacaacguccacccccucaccaucggcgagugccccaaguacgucaagagcgagaagcuggugcuggccacgggccuccgcaacgugccgcagaucgagucccgggggcuguucggcgccaucgcgggguucaucgagggcggguggcagggcaugguggacggcugguacggguaccaccacagcaacgaccagggcuccggguacgccgccgacaaggagagcacccagaaggccuucgaccgcaucaccaacaaggugaacuccgucaucgagaagaugaacacccaguucgaggccgugggcaaggaguucagcaaccuggagaagcggcucgagaaccugaacaagaagauggaggacggguuccuggacguguggacguacaacgcggagcuccugguccugauggagaacgagcgcacccucgacuuccacgacuccaacgugaagaaccuguacaacaagguccggaugcagcugcgcgacaacgugaaggagcucggcaacggcugcuucgaguucuaccacaagugcgacgacgagugcaugagcuccgugaagaacgggaccuacgacuaccccaaguacgaggaggagagcaagcugaagcggaacgagaucaagggcgucaagcuguccagcauggggguguaccagauccucgccaucuacgccaccguggccggcucccugagccuggccaucaugaucgcgggcaucucccucuggaugugcagcaacgggagccugcagugccgcaucugcaucuga

SEQ ID NO: 62681 - RNA, 1689 nt, Artificial Sequence
  derived and/or modified sequence opt1 from hemagglutinin__InfluenzaA__ABQ44460
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugaucuggcugacgaagaaggggagcaacuaccccguggcgaagggcuccuacaacaacaccagcggcgagcagaugcucaucaucuggggcgugcaccacccgaacgacgagaccgagcagcggacccuguaccagaacgucgggacguacguguccguggggaccagcacccugaacaagcgcuccacccccgacaucgccacgcggcccaaggucaacggccucggcagccgcauggaguucuccuggacccugcuggacaugugggacaccaucaacuucgagagcaccgggaaccucaucgcccccgaguacggcuucaagaucuccaagcgggggagcagcggcaucaugaagacggaggggacccugggcaacugcgagaccaagugccagaccccgcugggcgccaucaacacgacccuccccuuccacaacgugcacccccugaccaucggggagugccccaaguacgugaaguccgagaagcugguccucgcgaccggccugcgcaacgugccgcagaucgagagccgggggcuguucggcgccaucgccggguucaucgagggcggcuggcaggggaugguggacggcugguacggguaccaccacuccaacgaccagggcagcggguacgccgccgacaaggaguccacgcagaaggcguucgacggcaucaccaacaaggucaacagcgugaucgagaagaugaacacccaguucgaggccgugggcaaggaguucuccaaccucgagcgccggcuggagaaccugaacaagaagauggaggacggguuccucgacgucuggaccuacaacgccgagcugcuggugcucauggagaacgagcgcacgcuggacuuccacgacagcaacgugaagaaccuguacgacaagguccggaugcagcuccgcgacaacgugaaggagcugggcaacgggugcuucgaguucuaccacaagugcgacgacgagugcaugaacuccgucaagaacggcaccuacgacuaccccaaguacgaggaggagagcaagcugaaccggaacgagaucaagggcgugaagcucuccagcauggggguguaccagauccuggccaucuacgccaccgucgcgggcucccugagccucgccaucaugauggccgggaucuccuucuggaugugcagcaacggcucccugcagugccgcaucugcaucuga

SEQ ID NO: 62682 - RNA, 1701 nt, Artificial Sequence
  derived and/or modified sequence opt1 from hemagglutinin__InfluenzaA__ABQ44471
augaaggcccgccugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccggcugaagggcaucgcgccccuccagcuggggaagugcaacaucgccggcuggauccuggggaacccggagugcgagagccuccuguccaaccgcagcugguccuacaucgccgagacccccaacagcgagaacgggaccugcuaccccggcgacuucgccgacuacgaggagcugcgggagcagcucuccagcguguccagcuucgagcgcuucgagaucuuccccaaggagcgguccuggccgaagcacaacaucacccgcggggugacggccgccugcagccacgcgaagaaguccagcuucuacaagaaccugcuguggcucaccgaggccaacggcuccuaccccaaccugagcaaguccuacgucaacaacaaggagaaggaggugcuggugcucuggggcguccaccaccccagcaacaucgaggaccagcggacccuguaccgcaaggagaacgccuacgugagcguggucuccagcaacuacaaccggcgcuucacccccgagaucgccgagcggccgaaggugcgcggccaggccgggcggaugaacuacuacuggacgcugcucgagcccggcgacaagaucaucuucgaggcgaacggcaaccugaucgcccccugguacgccuucgcccugucccgcgggcucggcagcgggaucaucaccuccaacgccagcauggacgagugcgacaccaagugccagacgccccagggcgcgaucaacaacucccugccguuccagaacauccaccccgugaccaucggcgagugccccaaguacguccggagcaccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgccgccgaccagaaguccacgcagaacgcgaucaacgggaucaccaacaaggucaacagcgugaucgagaagaugaacacccaguucaccgccgugggcaaggaguucaacaagcuggagaagcggauggagaaccucaacaagaaggucgacgacggcuuccuggacaucuggacguacaacgccgagcugcucgugcugcuggagaacgagcgcacccucgacuuccacgacagcaacgugaagaaccuguacgagaaggucaagaaccagcugcggaacaacgccaaggagaucgggaacggcugcuucgaguucuaccacaagugcgacaacgagugcauggaguccgugaagaacgggaccuacgacuacccgaaguacagcgaggaguccaagcucaaccgcgagaagaucgacggcgucaagcuggagagcauggggguguaccagauccuggccaucuacuccaccguggcgagcagccucguccugcuggugucccucggcgccaucagcuucuggaugugcuccaacggcagccugcagugccgcaucugcaucuga

SEQ ID NO: 62683 - RNA, 1701 nt, Artificial Sequence
  derived and/or modified sequence opt1 from hemagglutinin__InfluenzaA__ABR15797
augaagaccaucaucgcccugagcuacaucuucugccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagagcggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 62684 - RNA, 1701 nt, Artificial Sequence
  derived and/or modified sequence opt1 from hemagglutinin__InfluenzaA__ABR15808
augaaggcccgccugcucauccugcugugcgcccucagcgcgaccgacgccgacaccaucugcaucggcuaccacgccaacaacuccacggacaccguggacaccguccuggagaagaacgugaccgugacgcacagcgucaaccugcucgaggacucccacaacgggaagcugugccggcugaagggcaucgcgccccuccagcuggggaagugcaacaucgccggcuggauccuggggaacccggagugcgagagccuccuguccaaccgcagcugguccuacaucgccgagacccccaacagcgagaacgggaccugcuaccccggcgacuucgccgacuacgaggagcugcgggagcagcucuccagcguguccagcuucgagcgcuucgagaucuuccccaaggagcgguccuggccgaagcacaacaucacccgcggggugacggccgccugcagccacgcgaagaaguccagcuucuacaagaaccugcuguggcucaccgaggccaacggcuccuaccccaaccugagcaaguccuacgucaacaacaaggagaaggaggugcuggugcucuggggcguccaccaccccagcaacaucgaggaccagcggacccuguaccgcaaggagaacgccuacgugagcguggucuccagcaacuacaaccggcgcuucacccccgagaucgccgagcggccgaaggugcgcggccaggccgggcggaugaacuacuacuggacgcugcucgagcccggcgacaagaucaucuucgaggcgaacggcaaccugaucgcccccugguacgccuucgcccugucccgcgggcucggcagcgggaucaucaccuccaacgccagcauggacgagugcgacaccaagugccagacgccccagggcgcgaucaacuccagccugccguuccagaacauccaccccgugaccaucggcgagugccccaaguacguccgguccaccaagcugcgcauggugaccgggcuccggaacauccccagcauccagucccgcggccuguucggggccaucgccggcuucaucgagggcggguggaccggcaugguggacgggugguacggcuaccaccaccagaacgagcaggggagcggcuacgccgccgaccagaaguccacgcagaacgcgaucaacgggaucaccaacaaggucaacagcgugaucgagaagaugaacacccaguucaccgccgugggcaaggaguucaacaagcuggagaagcggauggagaaccucaacaagaaggucgacgacggcuuccuggacaucuggacguacaacgccgagcugcucgugcugcuggagaacgagcgcacccucgacuuccacgacuccaacgugaagaaccuguacgagaaggucaagaaccagcugcggaacaacgccaaggagaucgggaacggcugcuucgaguucuaccacaagugcgacaacgagugcauggagagcgugaagaacgggaccuacgacuacccgaaguacuccgaggagagcaagcucaaccgcgagaagaucgacggcgucaagcuggaguccauggggguguaccagauccuggccaucuacagcaccguggcgagcucccucguccugcuggugagccucggcgccaucuccuucuggaugugcagcaacggcucccugcagugccgcaucugcaucuga

SEQ ID NO: 62685 - RNA, 1698 nt, Artificial Sequence; identical to SEQ ID NO: 61750
  derived and/or modified sequence opt1 from hemagglutinin__InfluenzaA__ABR15885

SEQ ID NO: 62686 - RNA, 1698 nt, Artificial Sequence
  derived and/or modified sequence opt1 from hemagglutinin__InfluenzaA__ABR15896
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgaggcccccaaccccgagaacgggaccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcauguccuacgugaacaacaaggagaaggaggugcucguccuguggggcgugcaccacccgcccaacaucggcgaccagcgggcccuguaccacaccgagaacgccuacgugagcgucgugagcucccacuacagccgccgguucacgcccgagaucgcgaagcgccccaaggugcgggaccaggagggccgcaucaacuacuacuggacccuccuggagcccggggacaccaucaucuucgaggccaacggcaaccugaucgccccgugguacgccuucgcccucucccggggguucggcagcggcaucaucaccuccaacgcgcccauggacgagugcgacgccaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgcgggcuucaucgagggcggguggaccggcaugguggacgggugguacggcuaccaccaccagaacgagcagggguccggcuacgccgccgaccagaaguccacgcagaacgccaucaacggcaucaccaacaaggugaacagcgucaucgagaagaugaacacccaguucaccgccguggggaaggaguucaacaagcuggagcgccggauggagaaccucaacaagaaggucgacgacggcuuccuggacaucuggacguacaacgcggagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcaccguggccagcucccucgugcugcuggucagccucggggccaucuccuucuggaugugcagcaacggcucccugcagugccgcaucugcaucuga

SEQ ID NO: 62687 - RNA, 1698 nt, Artificial Sequence; identical to SEQ ID NO: 61749
  derived and/or modified sequence opt1 from hemagglutinin__InfluenzaA__ABR15907

SEQ ID NO: 62688 - RNA, 1698 nt, Artificial Sequence; identical to SEQ ID NO: 61750
  derived and/or modified sequence opt1 from hemagglutinin__InfluenzaA__ABR15918

SEQ ID NO: 62689 - RNA, 1701 nt, Artificial Sequence
  derived and/or modified sequence opt1 from hemagglutinin__InfluenzaA__ABR15929
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcaucuccagccgcaucuccaucuacuggacgaucgucaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgugaagcagaacacgcucaagcuggccaccgggaugcgcaacguccccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacguggaggacaccaagaucgaccucuggagcuacaacgccgagcugcuggucgcccucgagaaccagcacaccaucgaccugacggacuccgagaugaacaagcuguucgagcggaccaagaagcagcuccgcgagaacgccgaggacauggggaacggcugcuucaagaucuaccacaagugcaacaacgccugcaucgggagcauccgcaacggcaccuacgaccacgacguguaccgggacgaggcgcugaacaaccgcuuccagaucaaggggguggagcugaaguccggcuacaaggacuggauccucuggaucagcuucgccaucagcugcuuccugcugugcaucguccuccugggcuucaucaugugggccugccagaaggggaacauccggugcaacaucugcaucuga

SEQ ID NO: 62690 - RNA, 1701 nt, Artificial Sequence
  derived and/or modified sequence opt1 from hemagglutinin__InfluenzaA__ABR15940
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcaucuccaacgacaagcccuuccagaacgugaaccgcaucaccuacggcgccugcccccgguacgucaagcagaacacgcucaagcuggccaccgggaugcgcaacgugccggagaagcagacccggggcaucuucggggccaucgccggcuucaucgagaacggcugggaggggaugauggacggcugguacggguuccgccaccagaacagcgagggcaccgggcaggccgccgaccugaaguccacgcaggcggccaucaaccagaucaacggcaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacguguaccgggacgaggcccugaacaaccgcuuccagaucaagggggucgagcugaaguccggcuacaaggacugggugcucuggaucagcuucgccaucuccugcuuccugcugugcaucguccuccugggcuucaucaugugggccugccagaaggggaacauccggugcaacaucugcaucuga

SEQ ID NO: 62691 - RNA, 1701 nt, Artificial Sequence; identical to SEQ ID NO: 61570
  derived and/or modified sequence opt1 from hemagglutinin__InfluenzaA__ABR15951

SEQ ID NO: 62692 - RNA, 1701 nt, Artificial Sequence
  derived and/or modified sequence opt1 from hemagglutinin__InfluenzaA__ABR15962
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagccgcgccuacuccaacugcuaccccuacgacgugccggacuacgucagccuccggucccugguggcgagcuccggcacgcuggaguucaacaacgagagcuucaacuggaccgggguggcccagaacggcaccuccagcgccugcaagcgccgguccgacaagagcuucuucucccgccucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgggugaccgucagcaccaagcgcucccagcagaccgugaucccgaacaucggcagccggcccugggugcgcggcgucuccagcaucaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgucaagcagaacacgcucaagcuggccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaagggggucgagcugaaguccggcuacaaggacuggauccucuggaucagcuucgccaucagcugcuuccugcugugcaucgugcuccugggcuucaucaugugggccugccagaaggggaacauccggugcaacaucugcaucuga

SEQ ID NO: 62693 - RNA, 1701 nt, Artificial Sequence
  derived and/or modified sequence opt1 from hemagglutinin__InfluenzaA__ABR22241
augaagaccaucaucgcccugagcuacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagagcuccagcaccgggcgcaucugcgacagcccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccagccuccgcucccugguggccagcuccggcacgcuggaguucaacaacgagagcuucaacuggaccggggucgcccagaacggcaccuccagcgcgugcaagcggcgcuccaucaagagcuucuucucccggcucaacuggcugcaccagcuggaguaccgcuaccccgcccucaacgugaccaugcccaacaacgacaaguucgacaagcuguacaucuggggcgugcaccaccccagcacggacuccgaccagaucagcgucuacgcccaggccagcgggcgggugaccguguccaccaagcgcagccagcagaccgucaucccgaacaucgggucccggcccugggugcgcggcaucagcucccggaucagcaucuacuggacgaucgugaagcccggcgacauccugcucaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgucaaccggaucaccuacggggccugcccgcgcuacgugaagcagaacacgcugaagcucgccaccggcaugcggaacgugcccgagaagcagacccgcgggaucuucggcgccaucgccggguucaucgagaacggcugggagggcaugauggacgggugguacggcuuccggcaccagaacagcgaggggaccggccaggcggccgaccugaaguccacgcaggccgccaucaaccagaucaacgggaagcugaacaagcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagaacaccaucgaccucacggacagcgagaugaacaagcuguucgagcggacccgcaagcagcugcgcgagaacgccgaggacaugggcaacgggugcuucaagaucuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgugguccugcucggcuucaucaugugggcgugccagaagggcaacauccgcugcaacaucugcaucuga

SEQ ID NO: 62694 - RNA, 1701 nt, Artificial Sequence; identical to SEQ ID NO: 61658
  derived and/or modified sequence opt1 from hemagglutinin__InfluenzaA__ABR28515

SEQ ID NO: 62695 - RNA, 1701 nt, Artificial Sequence
  derived and/or modified sequence opt1 from hemagglutinin__InfluenzaA__ABR28592
augaagaccaucaucgcccugagcuacguguucugccucgucuucgcccaggaccugcccggcaacgacaacuccaccgcgacgcugugccucgggcaccacgccgugccgaacggcacccuggugaagaccaucaccaacgaccagaucgaggucacgaacgccaccgagcuggugcagagcuccagcaccgggaagaucugcgacaacccccaccgcauccucgacggcaucaacugcacccugaucgacgcccugcucggggacccccacugcgacggcuuccagaacgagaagugggaccuguucguggagcgguccaaggccuucagcaacugcuaccccuacgacgucccggacuacgcgucccugcgcagccucguggccuccagcggcacgcuggaguucaucaacgagggguucaacuggaccggcgugacccagaacgggggcuccagcgccugcaagcgggggcccgacaacggcuucuucucccgccugaacuggcucuacaagagcggcuccaccuaccccguccagaacgugacgaugcccaacaacgacaacagcgacaagcuguacaucuggggcgugcaccacccguccaccgacaaggagcagaccgaccuguacguccaggccagcgggaaggugaccguguccacgaagcggagccagcagaccgucauccccaacguggggagccgccccugggugcggggccucuccagccgcgucuccaucuacuggaccaucgugaagcccggcgacauccuggugaucaacagcaacgggaaccugaucgcgccgcggggcuacuucaagaugcgcaccgggaaguccagcaucaugcgguccgacgcccccaucggcacgugcagcuccgagugcaucacccccaacgggagcauccccaacgacaagccguuccagaacgucaacaagaucaccuacggcgccugccccaaguacgugaagcagaacacccucaagcuggccacgggcaugcgcaacgugcccgagaagcagacccgggggaucuucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggucaucgagaagacgaacgagaaguuccaccagaucgagaaggaguucuccgagguggagggccgcauccaggaccuggagaaguacgucgaggacaccaagaucgaccuguggagcuacaacgcggagcuccugguggcccuggagaaccagcacaccaucgaccucaccgacuccgagaugaacaagcuguucgagaagacgcggcgccagcugcgggagaacgccgaggacauggggaacggcugcuucaagaucuaccacaagugcgacaacgccugcaucggcagcauccgcaacgggaccuacgaccacgacguguaccgggacgaggcccucaacaaccgcuuccagaucaagggcgucgagcugaaguccggguacaaggacuggauccuguggaucagcuucgcgaucuccugcuuccuccugugcguggugcugcucggcuucaucaugugggccugccagaagggcaacauccgcugcaacaucugcaucuga

SEQ ID NO: 62696 - RNA, 1698 nt, Artificial Sequence; identical to SEQ ID NO: 61750
  derived and/or modified sequence opt1 from hemagglutinin__InfluenzaA__ABR28768

SEQ ID NO: 62697 - RNA, 1698 nt, Artificial Sequence; identical to SEQ ID NO: 61750
  derived and/or modified sequence opt1 from hemagglutinin__InfluenzaA__ABR28779

SEQ ID NO: 62698 - RNA, 1701 nt, Artificial Sequence; identical to SEQ ID NO: 62441
  derived and/or modified sequence opt1 from hemagglutinin__InfluenzaA__ABR28790

SEQ ID NO: 62699 - RNA, 1698 nt, Artificial Sequence; identical to SEQ ID NO: 61750
  derived and/or modified sequence opt1 from hemagglutinin__InfluenzaA__ABR28801

SEQ ID NO: 62700 - RNA, 1701 nt, Artificial Sequence; identical to SEQ ID NO: 61658
  derived and/or modified sequence opt1 from hemagglutinin__InfluenzaA__ABR28812

SEQ ID NO: 62701 - RNA, 1701 nt, Artificial Sequence
  derived and/or modified sequence opt1 from hemagglutinin__InfluenzaA__ABR28823
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcaucuccagccgcaucuccaucuacuggacgaucgucaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgugaagcagaacacgcucaagcuggccaccgggaugcgcaacguccccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggccgcgaucaaccagaucaacggcaagcucaaccggcugaucgagaagaccaacgagaaguuccaccagaucgagaaggaguucuccgagguggagggccgcauccaggaccuggagaaguacguggaggacaccaagaucgaccucuggagcuacaacgccgagcugcuggucgcccucgagaaccagcacaccaucgaccugacggacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcgcugaacaaccgcuuccagaucaaggggguggagcugaaguccggcuacaaggacuggauccucuggaucagcuucgccaucagcugcuuccugcugugcaucguccuccugggcuucaucaugugggccugccagaaggggaacauccggugcaacaucugcaucuga

SEQ ID NO: 62702 - RNA, 1698 nt, Artificial Sequence; identical to SEQ ID NO: 61878
  derived and/or modified sequence opt1 from hemagglutinin__InfluenzaA__ABR28834

SEQ ID NO: 62703 - RNA, 1698 nt, Artificial Sequence; identical to SEQ ID NO: 61849
  derived and/or modified sequence opt1 from hemagglutinin__InfluenzaA__ABR28845

SEQ ID NO: 62704 - RNA, 1701 nt, Artificial Sequence
  derived and/or modified sequence opt1 from hemagglutinin__InfluenzaA__ABR28856
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaucaugcccaacaacgagaaguucgacaagcuguacaucuggggcgugcaccaccccgggaccgacagcgaccagaucucccuguacgcgcaggccagcgggcgcgugacggucagcaccaagcggucccagcagaccgugaucccgaacaucggcagccgccccugggugcggggcgucuccagccgcaucuccaucuacuggaccaucgugaagcccggggacauccuccugaucaacagcacgggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaagacccucaagcuggccacggggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacccaggcggccaucaaccagaucaacggcaagcucaaccggcugaucgagaagacgaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugaccgacuccgagaugaacaagcuguucgagcggacgaagaagcagcuccgcgagaacgccgaggacauggggaacggcugcuucaagaucuaccacaagugcgacaacgcgugcaucgggagcauccgcaacggcaccuacgaccacgacguguaccgggacgaggcccugaacaaccgcuuccagaucaagggggucgagcugaaguccggcuacaaggacuggauccucuggaucagcuucgccaucagcugcuuccugcugugcaucgugcuccugggcuucaucaugugggccugccagaaggggaacauccggugcaacaucugcaucuga

SEQ ID NO: 62705 - RNA, 1701 nt, Artificial Sequence; identical to SEQ ID NO: 61615
  derived and/or modified sequence opt1 from hemagglutinin__InfluenzaA__ABR28867

SEQ ID NO: 62706 - RNA, 1701 nt, Artificial Sequence; identical to SEQ ID NO: 61570
  derived and/or modified sequence opt1 from hemagglutinin__InfluenzaA__ABR28878

SEQ ID NO: 62707 - RNA, 1698 nt, Artificial Sequence; identical to SEQ ID NO: 62212
  derived and/or modified sequence opt1 from hemagglutinin__InfluenzaA__ABR28900

SEQ ID NO: 62708 - RNA, 1701 nt, Artificial Sequence
  derived and/or modified sequence opt1 from hemagglutinin__InfluenzaA__ABR28922
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcguguccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 62709 - RNA, 1701 nt, Artificial Sequence; identical to SEQ ID NO: 62589
  derived and/or modified sequence opt1 from hemagglutinin__InfluenzaA__ABR88080

SEQ ID NO: 62710 - RNA, 1701 nt, Artificial Sequence
  derived and/or modified sequence opt1 from hemagglutinin__InfluenzaA__ABS00315
augaaggccaagcugcucgugcugcugugcgccuucaccgcgaccgacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccggagugcgagagccuguucuccaagaaguccuggagcuacaucgccgagacccccaacagcgagaacgggaccugcuaccccggcuacuucgccgacuacgaggagcuccgggagcagcuguccagcgucuccagcuucgagcgcuucgagaucuuccccaaggaguccagcuggccgaaccacacggugaccaagggcguguccgccagcugcucccacaagggccggagcuccuucuaccgcaaccugcucuggcugaccgagaagaacgggagcuaccccaaccugagcaaguccuacgucaacaacaaggagcgggaggugcucgugcuguggggcguccaccaccccagcaacaucggggagcagcgcgccaucuaccacaccgagaacgcguacguguccguggucagcucccacuacaaccggcgcuucacgcccgagaucgccaagcggccgaaggugcgcggccaggagggccggaucaacuacuacuggacccugcucgagcccggggacaccaucaucuucgaggccaacggcaaccugaucgcccccugguacgccuucgcgcugagccgcggguucggcuccggcaucaucaccagcaacgccuccauggacgagugcgacgccaagugccagacgccccagggggccaucaacagcucccucccguuccagaacgugcaccccgucaccaucggcgagugccccaaguacgugcggagcaccaagcugcgcauggugaccgggcugcggaacauccccuccauccagagccgcggccucuucggggccaucgcgggcuucaucgagggcggguggacgggcaugaucgacgggugguacggcuaccaccaccagaacgagcagggguccggcuacgccgccgaccagaaguccacccagaacgccaucaacggcaucaccaacaaggucaacagcgugaucgagaagaugaacacccaguucacggccguggggaaggaguucaacaagcuggagcggcgcauggagaaccugaacaagaaggucgacgacggcuuccucgacaucuggaccuacaacgcggagcugcuggugcuccuggagaacgagcggacccuggacuuccacgacagcaacgucaagaaccucuacgagaaggugaagucccagcugaagaacaacgccaaggagaucgggaacggcugcuucgaguucuaccacaagugcaacaacgagugcauggagagcgugaagaacgggaccuacgacuacccgaaguacagcgaggaguccaagcugaaccgcgagaagaucgacggcgucaagcucgagagcaugggcguguaccagauccuggccaucuacuccacgguggccagcucccugguccuccuggugagccugggggccaucuccuucuggaugugcagcaacggcucccuccagugccggaucugcaucuga

SEQ ID NO: 62711 - RNA, 1701 nt, Artificial Sequence
  derived and/or modified sequence opt1 from hemagglutinin__InfluenzaA__ABS00326
augaaggccaagcugcucgugcugcugugcgccuucaccgcgaccgacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccggagugcgagagccuguucuccaagaaguccuggagcuacaucgccgagacccccaacagcgagaacgggaccugcuaccccggcuacuucgccgacuacgaggagcuccgggagcagcuguccagcgucuccagcuucgagcgcuucgagaucuuccccaaggaguccagcuggccgaaccacacggugaccaagggcguguccgccagcugcucccacaagggccggagcuccuucuaccgcaaccugcucuggcugaccgagaagaacgggagcuaccccaaccugagcaaguccuacgucaacaacaaggagaaggaggugcucgugcuguggggcguccaccaccccagcaacaucggggagcagcgggccaucuaccacaccgagaacgcguacguguccguggucagcucccacuacaaccgccgguucacgcccgagaucgccaagcgcccgaaggugcggggccaggagggccgcaucaacuacuacuggacccugcucgagcccggggacaccaucaucuucgaggccaacggcaaccugaucgcccccugguacgccuucgcgcugagccggggguucggcuccggcaucaucaccagcaacgccuccauggacgagugcgacgccaagugccagacgccccagggggccaucaacagcucccucccguuccagaacgugcaccccgucaccaucggcgagugccccaaguacgugcgcagcaccaagcugcggauggugaccgggcugcgcaacauccccuccauccagagccggggccucuucggggccaucgcgggcuucaucgagggcggguggacgggcaugaucgacgggugguacggcuaccaccaccagaacgagcagggguccggcuacgccgccgaccagaaguccacccagaacgccaucaacggcaucaccaacaaggucaacagcgugaucgagaagaugaacacccaguucacggccguggggaaggaguucaacaagcuggagcgccggauggagaaccugaacaagaaggucgacgacggcuuccucgacaucuggaccuacaacgcggagcugcuggugcuccuggagaacgagcgcacccuggacuuccacgacagcaacgucaagaaccucuacgagaaggugaagucccagcugaagaacaacgccaaggagaucgggaacggcugcuucgaguucuaccacaagugcaacaacgagugcauggagagcgugaagaacgggaccuacgacuacccgaaguacagcgaggaguccaagcugaaccgggagaagaucgacggcgucaagcucgagagcaugggcguguaccagauccuggccaucuacuccacgguggccagcucccugguccuccuggugagccugggggccaucuccuucuggaugugcagcaacggcucccuccagugccgcaucugcaucuga

SEQ ID NO: 62712 - RNA, 1701 nt, Artificial Sequence; identical to SEQ ID NO: 62648
  derived and/or modified sequence opt1 from hemagglutinin__InfluenzaA__ABS49899

SEQ ID NO: 62713 - RNA, 1701 nt, Artificial Sequence
  derived and/or modified sequence opt1 from hemagglutinin__InfluenzaA__ABS49910
augaagaccaucaucgcccugagcuacaucuucugccucgcccugggccaggaccugcccgggaacgacaacuccaccgcgacgcucugccugggccaccacgccgugccgaacgggacccuggucaagaccaucaccaacgaccagaucgaggugacgaacgccaccgagcucgugcagagcuccagcaccggcaagaucugcaacaacccccaccgcauccuggacgggaucaacugcacccugaucgacgcccuccugggcgacccccacugcgacgucuuccaggacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagaugcgggagaacgccgaggacauggggaacggcugcuucaagaucuaccacaagugcgacaacgccugcaucgaguccauccgcaacggcaccuacgaccacgacguguaccgcgacgaggcccugaacaaccgguuccagaucaagggggucgagcucaagagcggcuacaaggacuggauccuguggaucuccuucgcgaucagcugcuuccugcucugcguggugcugcugggguucaucaugugggccugccagcgcggcaacauccggugcaacaucugcaucuga

SEQ ID NO: 62714 - RNA, 1701 nt, Artificial Sequence; identical to SEQ ID NO: 61658
  derived and/or modified sequence opt1 from hemagglutinin__InfluenzaA__ABS49965

SEQ ID NO: 62715 - RNA, 1698 nt, Artificial Sequence
  derived and/or modified sequence opt1 from hemagglutinin__InfluenzaA__ABS49976
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacaacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 62716 - RNA, 1698 nt, Artificial Sequence
  derived and/or modified sequence opt1 from hemagglutinin__InfluenzaA__ABS49987
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacaugaagaaccuguacgagaaggugaagucccagcugaagaacaacgcgaaggagaucgggaacggcugcuucgaguucuaccacaagugcaacaacgagugcauggagagcgucaagaacgggaccuacgacuaccccaaguacuccgaggagagcaagcucaaccgcgagaagaucgacggcgugaagcuggaguccaugggcguguaccagauccuggccaucuacagcacggucgccagcucccucgugcugcuggugagccucggggccaucuccuucuggaugugcagcaacggcucccugcagugccggaucugcaucuga

SEQ ID NO: 62717 - RNA, 1701 nt, Artificial Sequence
  derived and/or modified sequence opt1 from hemagglutinin__InfluenzaA__ABS49998
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaucaugcccaacaacgagaaguucgacaagcuguacaucuggggcguccaccaccccagcaccgacuccgaccagaucagccuguacgcccaggccccggggcgggugacggugagcaccaagcgcucccagcagaccgucauccccaacaucggcagccggcccugggugcgcggcguguccagccggaucuccaucuacuggaccaucgucaagcccggggacauccuccugaucaacugcacgggcaaccugaucgccccgcgcggguacuucaagauccggagcggcaaguccagcaucaugcgcuccgacgccagcaucggcaagugcaacuccgagugcaucacccccaacgggagcauccccaacgacaagcccuuccagaacgugaaccggaucaccuacggcgcgugcccgcgcuacgugaagcagaacacccucaagcuggccacggggaugcggaacguccccgagaagcagacccgcggcaucuucggggccaucgccggcuucaucgagaacggcugggaggggaugguggacggcugguacggguuccggcaccagaacuccgagggcaccgggcaggccgcggaccugaaguccacccaggccgccaucaaccagaucaacggcaagcucaaccgccugaucgagaagacgaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugaccgacuccgagaugaacaagcuguucgagcgcacgaagaagcagcuccgggagaacgcggaggacauggggaacggcugcuucaagaucuaccacaagugcgacaacgccugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcgugguccuccugggcuucaucaugugggccugccagaaggggaacauccgcugcaacaucugcaucuga

SEQ ID NO: 62718 - RNA, 1701 nt, Artificial Sequence
  derived and/or modified sequence opt1 from hemagglutinin__InfluenzaA__ABS50009
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaacaacgagagcuucaacuggaccggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcacggacuccgaccagaucagccuguacgcccaggccccggggcgggugaccgugagcaccaagcgcucccagcagaccgucauccccaacaucggcagccggcccugggugcgcggcguguccagcaagaucuccaucuacuggacgaucgucaagcccggggacauccuccugaucaacugcaccggcaaccugaucgccccgcggggguacuucaagauccgcagcggcaaguccagcaucaugcgguccgacgccagcaucggcaagugcaacuccgagugcaucacccccaacgggagcauccccaacgacaagcccuuccagaacgugaaccgcaucaccuacggcgcgugcccgcgguacgugaagcagaacacgcucaagcuggccaccgggaugcgcaacguccccgagaagcagacccggggcaucuucggggccaucgccggcuucaucgagaacggcugggaggggaugguggacggcugguacggguuccgccaccagaacuccgagggcaccgggcaggccgcggaccugaaguccacgcaggccgccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgcggaggacauggggaacggcugcuucaagaucuaccacaagugcgacaacgccugcaucgggagcauccggaacggcaccuacgaccacgacguguaccgcgacgaggcccugaacaaccgcuuccagaucaagggggucgagcugaaguccggcuacaaggacuggauccucuggaucagcuucgccaucagcugcuuccugcugugcgugguccuccugggcuucaucaugugggccugccagaaggggaacauccggugcaacaucugcaucuga

SEQ ID NO: 62719 - RNA, 1701 nt, Artificial Sequence; identical to SEQ ID NO: 61718
  derived and/or modified sequence opt1 from hemagglutinin__InfluenzaA__ABS50020

SEQ ID NO: 62720 - RNA, 1701 nt, Artificial Sequence
  derived and/or modified sequence opt1 from hemagglutinin__InfluenzaA__ABS50031
augaagaccaucaucgcccugagcuacaugcucugccugguguucgcccagaagcugcccggcaacgacaacuccaccgcgaugcucugccuggggcaccacgccgucccgaacggcacgcuggugaagaccaucaccaacgaccagaucgaggugaccaacgccacggagcucguccagagcuccagcaccgggggcaucugcgacagcccccaccagauccuggacggggagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacccuggaguucaacaacgagagcuucaacuggacgggcguggcccagaacgggaccuccagcgccugcaagcgccgguccaacaagagcuucuucucccgccucaacuggcugcaccagcugaaguacaaguaccccgcgcucaacgugaccaugcccaacaacgagaaguucgacaagcuguacaucuggggcguccaccaccccagcaccgacuccgaccagaucagccuguacgcccaggccccggggcgggugacggugagcaccaagcgcucccagcagaccgucauccccaacaucggcagcggccccugggugcgcgggguguccagccggaucuccaucuacuggaccaucgucaagcccggcgacauccuccugaucaacugcacggggaaccugaucgccccgcggggcuacuucaagauccgcagcggcaaguccagcaucaugcgguccgacgccagcaucgggaagugcaacuccgagugcaucacccccaacggcagcauccccaacgacaagcccuuccagaacgugaaccgcaucaccuacggggcgugcccgcgguacgugaagcagaacacccucaagcuggccacgggcaugcgcaacguccccgagaagcagacccgggggaucuucggcgccaucgccggcuucaucgagaacgggugggagggcaugguggacgggugguacggcuuccgccaccagaacuccgaggggaccggccaggccgcggaccugaaguccacccaggccgccaucaaccagaucaacggcaagcucaaccggcugaucgagaagacgaacgagaaguuccaccagaucgagaaggaguucuccgagguggaggggcgcauccaggaccuggagaaguacgucgaggacaccaagaucgaccucuggagcuacaacgccgagcugcugguggcccucgagaaccagcacaccaucgaccugaccgacuccgagaugaacaagcuguucgagcggacgaagaagcagcuccgcgagaacgcggaggacaugggcaacgggugcuucaagaucuaccacaagugcgacaacgccugcaucggcagcauccggaacgggaccuacgaccacgacguguaccgcgacgaggcccugaacaaccgcuuccagaucaagggcgucgagcugaaguccggcuacaaggacuggauccucuggaucagcuucgccaucagcugcuuccugcugugcgugguccuccugggguucaucaugugggccugccagaagggcaacauccggugcaacaucugcaucuga

SEQ ID NO: 62721 - RNA, 1701 nt, Artificial Sequence; identical to SEQ ID NO: 61059
  derived and/or modified sequence opt1 from hemagglutinin__InfluenzaA__ABS50042

SEQ ID NO: 62722 - RNA, 1701 nt, Artificial Sequence; identical to SEQ ID NO: 62701
  derived and/or modified sequence opt1 from hemagglutinin__InfluenzaA__ABS50053

SEQ ID NO: 62723 - RNA, 1701 nt, Artificial Sequence
  derived and/or modified sequence opt1 from hemagglutinin__InfluenzaA__ABS50064
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcccgugcccccgguacgucaagcagacgacccucaagcuggccaccgggaugcgcaacgugcccgagaagcagacccggggcaucuucggggccaucgccggcuucaucgagaacggcugggaggggaugauggacggcugguacggguuccgccaccagaacuccgagggcacggggcaggccgccgaccugaaguccacccaggccgcgaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgccgagcugcuggugucccucgagaaccagcacacgaucgaccugaccgacagcgagaugaacaagcuguucgagcggaccaagaagcagcuccgcgagaacgccgaggacauggggaacggcugcuucaagaucuaccacaagugcgacaacgccugcaucggguccauccgcaacggcaccuacgaccacgacguguaccgggacgaggcccugaacaaccgcuuccagaucaagggggucgagcucaagagcggcuacaaggacuggauccuguggaucagcuucgcgaucuccugcuuccugcugugcaucgugcuccugggcuucaucaugugggccugccagaaggggaacauccggugcaacaucugcaucuga

SEQ ID NO: 62724 - RNA, 1701 nt, Artificial Sequence
  derived and/or modified sequence opt1 from hemagglutinin__InfluenzaA__ABS50075
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccacaagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62725 - RNA, 1698 nt, Artificial Sequence
  derived and/or modified sequence opt1 from hemagglutinin__InfluenzaA__ABS71665
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucucccgcgagagcugguccuacaucguggagaagcccagccccgagaacgggaccugcuaccccggccacuucgccgacuacgaggagcugcgggagcagcuguccagcguguccagcuucgagcgcuucgagaucuucccgaaggaguccagcuggcccaaccacacggccaccggggucuccgccagcugcucccacaacggcgagagcuccuucuacaagaaccuccuguggcugaccgggaagaacggccucuaccccaaccugagcaagagcuacgccaacaacaaggagaaggaggugcuggugcucuggggcguccaccacccgcccaacaucggcgaccagcgggcccuguaccacaccgagaacgccuacguguccguggucagcucccacuacagccgcaaguucacgcccgagaucgcgaagcggcccaaggugcgcgaccaggagggccggaucuccuacuacuggacccugcucgagcccggggacaccaucaucuucgaggccaacggcaaccugaucgccccgcgcuacgccuucgcccugagccggggguucggcuccggcaucaucaacagcaacgcgcccauggacgagugcgacgccaagugccagacgccccagggggccaucaacuccagccuccccuuccagaacgugcacccggucaccaucggcgagugccccaaguacgugcgcuccgccaagcugcggauggugaccgggcugcgcaacauccccagcauccagucccggggccucuucggggccaucgcgggcuucaucgagggcggguggaccggcauggucgacgggugguacggcuaccaccaccagaacgagcaggggagcggcuacgccgccgaccagaaguccacccagaacgccaucaacggcaucacgaacaaggugaacagcgugaucgagaagaugaacacccaguucaccgccgucgggaaggaguucaacaagcuggagcgccggauggagaaccugaacaagaagguggacgacggcuucaucgacaucuggaccuacaacgcggagcuccugguccugcucgagaacgagcgcacgcuggacuuccacgacuccaacgugaagaaccuguacgagaaggucaagagccagcucaagaacaacgccaaggagaucgggaacggcugcuucgaguucuaccacaagugcaacgacgagugcauggaguccgugaagaacgggaccuacgacuaccccaaguacagcgaggagagcaagcugaaccgggagaagaucgacggcgugaagcuggaguccaugggcguguaccagauccucgccaucuacagcaccgucgccuccagccuggugcugcucgugucccugggggccaucagcuucuggaugugcuccaacggcagccugcagugccgcaucugcaucuga

SEQ ID NO: 62726 - RNA, 1698 nt, Artificial Sequence
  derived and/or modified sequence opt1 from hemagglutinin__InfluenzaA__ABS71666
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucucccgcgagagcugguccuacaucguggagaagcccagccccgagaacgggaccugcuaccccggccacuucgccgacuacgaggagcugcgggagcagcuguccagcguguccagcuucgagcgcuucgagaucuucccgaaggaguccagcuggcccaaccacacggccaccggggucuccgccagcugcucccacaacggcaagagcuccuucuacaagaaccuccuguggcugaccgggaagaacggccucuaccccaaccugagcaagagcuacgccaacaacaaggagaaggaggugcuggugcucuggggcguccaccacccgcccaacaucggcgaccagcgggcccuguaccacaccgagaacgccuacguguccguggucagcucccacuacagccgcaaguucacgcccgagaucgcgaagcggcccaaggugcgcgaccaggagggccggaucuccuacuacuggacccugcucgagcccggggacaccaucaucuucgaggccaacggcaaccugaucgccccgcgcuacgccuucgcccugagccggggguucggcuccggcaucaucaacagcaacgcgcccauggacgagugcgacgccaagugccagacgccccagggggccaucaacuccagccuccccuuccagaacgugcacccggucaccaucggcgagugccccaaguacgugcgcuccgccaagcugcggauggugaccgggcugcgcaacauccccagcauccagucccggggccucuucggggccaucgcgggcuucaucgagggcggguggaccggcauggucgacgggugguacggcuaccaccaccagaacgagcaggggagcggcuacgccgccgaccagaaguccacccagaacgccaucaacggcaucacgaacaaggugaacagcgugaucgagaagaugaacacccaguucaccgccgucgggaaggaguucaacaagcuggagcgccggauggagaaccugaacaagaagguggacgacggcuucaucgacaucuggaccuacaacgcggagcuccugguccugcucgagaacgagcgcacgcuggacuuccacgacuccaacgugaagaaccuguacgagaaggucaagagccagcucaagaacaacgccaaggagaucgggaacggcugcuucgaguucuaccacaagugcaacgacgagugcauggaguccgugaagaacgggaccuacgacuaccccaaguacagcgaggagagcaagcugaaccgggagaagaucgacggcgugaagcuggaguccaugggcguguaccagauccucgccaucuacagcaccgucgccuccagccuggugcugcucgugucccugggggccaucagcuucuggaugugcuccaacggcagccugcagugccgcaucugcaucuga

SEQ ID NO: 62727 - RNA, 1698 nt, Artificial Sequence
  derived and/or modified sequence opt1 from hemagglutinin__InfluenzaA__ABS71667
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucucccgcgagagcugguccuacaucguggagaagcccagccccgagaacgggaccugcuaccccggccacuucgccgacuacgaggagcugcgggagcagcuguccagcguguccagcuucgagcgcuucgagaucuucccgaaggaguccagcuggcccaaccacacggccaccggggucuccgccagcugcucccacaacggcaagagcuccuucuacaagaaccuccuguggcugaccgggaagaacggccucuaccccaaccugagcaagagcuacgccaacaacaaggagaaggaggugcuggugcucuggggcguccaccacccgcccaacaucggcgaccagcgggcccuguaccacaccgagaacgccuacaucuccguggugagcucccacuacagccgcaaguucacgcccgagaucgcgaagcggcccaagguccgcgaccaggagggccggaucuccuacuacuggacccugcucgagcccggggacaccaucaucuucgaggccaacggcaaccugaucgccccgcgcuacgccuucgcccugagccggggguucggcuccggcaucaucaacagcaacgcgcccauggacgagugcgacgccaagugccagacgccccagggggccaucaacuccagccuccccuuccagaacgugcacccggugaccaucggcgagugccccaaguacguccgcuccgccaagcugcggauggugaccgggcugcgcaacauccccagcauccagucccggggccucuucggggccaucgcgggcuucaucgagggcggguggaccggcaugguggacgggugguacggcuaccaccaccagaacgagcaggggagcggcuacgccgccgaccagaaguccacccagaacgccaucaacggcaucacgaacaaggucaacagcgugaucgagaagaugaacacccaguucaccgccguggggaaggaguucaacaagcuggagcgccggauggagaaccugaacaagaaggucgacgacggcuucaucgacaucuggaccuacaacgcggagcuccuggugcugcucgagaacgagcgcacgcuggacuuccacgacuccaacgucaagaaccuguacgagaaggucaagagccagcucaagaacaacgccaaggagaucgggaacggcugcuucgaguucuaccacaagugcaacgacgagugcauggaguccgugaagaacgggaccuacgacuaccccaaguacagcgaggagagcaagcugaaccgggagaagaucgacggcgugaagcuggaguccaugggcguguaccagauccucgccaucuacagcaccguggccuccagccugguccugcucgugucccugggggccaucagcuucuggaugugcuccaacggcagccugcagugccgcaucugcaucuga

SEQ ID NO: 62728 - RNA, 1698 nt, Artificial Sequence
  derived and/or modified sequence opt1 from hemagglutinin__InfluenzaA__ABS71668
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagagccucaucucccgcgagagcugguccuacaucguggagaagcccagccccgagaacgggaccugcuaccccggccacuucgccgacuacgaggagcugcgggagcagcuguccagcguguccagcuucgagcgcuucgagaucuucccgaaggaguccagcuggcccaaccacacggccuccggggucagcgccuccugcagccacaacggcaaguccagcuucuacaagaaccuccuguggcugaccgggaagaacggccucuaccccaaccugagcaaguccuacgccaacaacaaggagaaggaggugcuggugcucuggggcguccaccacccgcccaacaucggcgaccagcgggcccuguaccacaccgagaacgccuacgugagcguggucuccagccacuacucccgcaaguucacccccgagaucgcgaagcggcccaaggugcgcgaccaggagggccggaucaacuacuacuggacgcugcucgagcccggggacaccaucaucuucgaggccaacggcaaccugaucgccccgcgcuacgccuucgcccugagccggggguucggcuccggcaucaucaacagcaacgcgcccauggacgagugcgacgccaagugccagacgccccagggggccaucaacuccagccuccccuuccagaacgugcacccggucaccaucggcgagugccccaaguacgugcgcuccgccaagcugcggauggugaccgggcugcgcaacauccccagcauccagucccggggccucuucggggccaucgcgggcuucaucgagggcggguggaccggcauggucgacgggugguacggcuaccaccaccagaacgagcaggggagcggcuacgccgccgaccagaaguccacccagaacgccaucaacggcaucaccaacaaggugaacagcgugaucgagaagaugaacacgcaguucaccgccgucgggaaggaguucaacaagcuggagcgccggauggagaaccugaacaagaagguggacgacggcuucaucgacaucuggaccuacaacgcggagcuccugguccugcucgagaacgagcgcacccuggacuuccacgacuccaacgugaagaaccuguacgagaaggucaagagccagcucaagaacaacgccaaggagaucgggaacggcugcuucgaguucuaccacaagugcaacgacgagugcauggaguccgugaagaacgggacguacgacuaccccaaguacagcgaggagagcaagcugaaccgggagaagaucgacggcgugaagcuggaguccaugggcguguaccagauccucgccaucuacagcaccgucgccuccagccuggugcugcucgugucccugggggccaucagcuucuggaugugcuccaacggcagccugcagugccgcaucugcaucuga

SEQ ID NO: 62729 - RNA, 1698 nt, Artificial Sequence
  derived and/or modified sequence opt1 from hemagglutinin__InfluenzaA__ABS71669
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 62730 - RNA, 1698 nt, Artificial Sequence
  derived and/or modified sequence opt1 from hemagglutinin__InfluenzaA__ABS71671
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagauguucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagcgcgcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 62731 - RNA, 1698 nt, Artificial Sequence
  derived and/or modified sequence opt1 from hemagglutinin__InfluenzaA__ABS71672
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcggcucuccagcguguccagcuucgagcgcuucgagauguucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgcccagcgggcccuguaccacaccgagaacgccuacgugagcgucgugagcucccacuacagccgcaaguucacgcccgagaucgcgaagcggcccaaggugcgcgaccaggagggccggaucaacuacuacuggacccuccuggagcccggggacaccaucaucuucgaggccaacggcaaccugaucgccccgcgcuacgccuucgcccucucccggggguucggcagcggcaucaucaacuccaacgcgcccauggacgagugcgacgccaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgcggagcugcuggugcuccuggagaacgagcgcacgcuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugucccgggagaagaucgacggcgugaagcucgagagcaugggcgucuaccagauccuggccaucuacagcaccguggccuccagccuggugcuccuggucucccugggggccaucagcuucuggaugugcuccaacggcagccuccagugccgcaucugcaucuga

SEQ ID NO: 62732 - RNA, 1698 nt, Artificial Sequence
  derived and/or modified sequence opt1 from hemagglutinin__InfluenzaA__ABS71673
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggccgcagcuccuucuaccggaaccugcuguggcucaccgggaagaacggccuguaccccaaccugagcaaguccuacgccaacaacaaggagaaggaggugcucguccuguggggcgugcaccacccgcccaacaucggggaccagcgcgcccuguaccacacggagaacaccuacgugagcgucgugagcucccacuacagccggcgcuucacccccgagaucgccaagcggcccaaggugcgcgaccaggagggccggaucaacuacuacuggacccuccuggagcccggggacacgaucaucuucgaggccaacggcaaccugaucgcgccgcgcuucgccuucgcccucucccggggguucggcagcggcaucaucaccuccaacgcccccauggacgagugcgacgccaagugccagacgccccagggggcgaucaacagcucccugcccuuccagaacguccacccggugaccaucggcgagugccccaaguacgugcgcagcgccaagcugcggauggccaccgggcuccgcaacauccccuccauccagagccggggccuguucggggccaucgccggcuucaucgagggcggguggaccggcauggucgacgggugguacggcuaccaccaccagaacgagcagggguccggcuacgcggccgaccagaaguccacccagaacgccaucaacggcaucaccaacaaggugaacagcgugaucgagaagaugaacacgcaguucaccgccgucgggaaggaguucagcaagcuggagcgccggauggagaaccucaacaagaagguggacgacggcuuccuggacaucuggaccuacaacgccgagcugcucguccugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggacguacgacuaccccaaguacagcgaggaguccaagcucaaccgggagaagaucgacggcgugaagcuggagagcaugggcguguaccagauccuggccaucuacagcaccgucgccuccagccucgugcugcuggugucccucggggccaucagcuucuggaugugcuccaacggcagccugcagugccgcaucugcaucuga

SEQ ID NO: 62733 - RNA, 1701 nt, Artificial Sequence; identical to SEQ ID NO: 61638
  derived and/or modified sequence opt1 from hemagglutinin__InfluenzaA__ABS71674

SEQ ID NO: 62734 - RNA, 1701 nt, Artificial Sequence
  derived and/or modified sequence opt1 from hemagglutinin__InfluenzaA__ABS71675
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggcccacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62735 - RNA, 1701 nt, Artificial Sequence
  derived and/or modified sequence opt1 from hemagglutinin__InfluenzaA__ABS71676
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgcggcagcaacaacuccuucuucagccggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccagcggccgcaucaccguguccacgaagcggagccagcagaccgugaucccgaacaucgggagccgcccccggguccgcaacauccccucccggaucagcaucuacuggaccaucgugaagcccggcgacauccugcugaucaacuccaccgggaaccucaucgccccgcgcggcuacuucaucauccggagcggcaaguccagcaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccucaaguccacccaggcggccaucgaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaagggcguggagcucaagagcggguacaaggacuggauccuguggaucuccuucgccaucagcugcuuccugcucugcguggcccugcugggcuucaucaugugggccugccagaaggggaacauccggugcaacaucugcaucuga

SEQ ID NO: 62736 - RNA, 1701 nt, Artificial Sequence
  derived and/or modified sequence opt1 from hemagglutinin__InfluenzaA__ABS71677
augaagaccaucaucgcccugagcuacauccucugccugguguucgcccagaagcugcccggcaucgacaacuccaccgcgacgcucugccuggggcaccacgccgucccgaacggcaccaucgugaagaccaucaccgacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgcggcagcaacaacuccuucuucagccggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccagcggccgcaucaccguguccacgaagcggagccagcagaccgugaucccgaacaucgggagccgcccccggguccgcaacauccccucccggaucagcaucuacuggaccaucgugaagcccggcgacauccugcugaucaacuccaccgggaaccucaucgccccgcgcggcuacuucaagauccggagcggcaaguccagcaucaugcgcuccgacgcccccaucgacaagugcaacagcgagugcaucacgcccaacggguccauccccaacgacaagccguuccagaacgugaaccggaucaccuacggcgccugcccccgcuacgucaagcagaacacccugaagcuggcgaccgggaugcggaacgugcccgagaagcagacgcgcggcaucuucggggccaucgccggcuucaucgagaacggcugggaggggaugguggacggcugguacggguuccggcaccagaacagcgagggcaucgggcaggccgccgaccucaaguccacccaggcggccaucgaccagaucaacggcaagcugaaccgccugaucggcaagaccaacgagaaguuccaccagaucgagaaggaguucagcgaggucgaggggcggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacaugggcaacgggugcuucaagaucuaccacaagugcgacaacgcgugcaucggcuccauccggaacgggaccuacgaccacgacgucuaccgcgacgaggcccugaacaaccgcuuccagaucaagggcguggagcucaagagcggcuacaaggacuggauccuguggaucuccuucgccaucagcugcuuccugcucugcguggcccugcugggguucaucaugugggccugccagaagggcaacauccggugcaacaucugcaucuga

SEQ ID NO: 62737 - RNA, 1701 nt, Artificial Sequence
  derived and/or modified sequence opt1 from hemagglutinin__InfluenzaA__ABS71679
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcggcuccaacaacagcuucuucucccggcugaacuggcucacgcacagcaaguucaaguaccccgcccugaacgugaccaugcccaacaacgaggaguucgacaagcuguacaucuggggcguccaccaccccgggaccgacaacgaccagaucuuccucuacgcgcaggccuccggccgcaucaccgugagcacgaagcggagccagcagaccgugaucccgaacaucgggucccgcccccggguccgcaacauccccagccggaucuccaucuacuggaccaucgugaagcccggcgacauccugcugaucaacagcaccgggaaccucaucgccccgcgcggcuacuucaagauccgguccggcaagagcuccaucaugcgcagcgacgcccccaucgggaagugcaacuccgagugcaucacgcccaacggcagcauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccucaagagcacccaggcggccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacgacgucuaccgcgacgaggcccugaacaaccgcuuccagaucaagggcguggagcucaaguccggguacaaggacuggauccuguggaucagcuucgccaucuccugcuuccugcucugcguggcccugcugggcuucaucaugugggccugccagaaggggaacauccggugcaacaucugcaucuga

SEQ ID NO: 62738 - RNA, 1701 nt, Artificial Sequence; identical to SEQ ID NO: 62737
  derived and/or modified sequence opt1 from hemagglutinin__InfluenzaA__ABS71680

SEQ ID NO: 62739 - RNA, 1701 nt, Artificial Sequence
  derived and/or modified sequence opt1 from hemagglutinin__InfluenzaA__ABS71682
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucuuccuguacgcgcaggccagcggccggaucaccgucuccacgaagcgcagccagcagaccgugaucccgaacaucggcagccggccccgcgugcggaacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacguguaccgcgacgaggcccucaacaaccgguuccagaucaagggcgucgagcugaaguccggcuacaaggacuggauccuguggaucuccuucgccaucagcugcuuccuccugugcguggugcugcucggguucaucaugugggccugccagaagggcaacauccgcugcaacaucugcaucuga

SEQ ID NO: 62740 - RNA, 1701 nt, Artificial Sequence
  derived and/or modified sequence opt1 from hemagglutinin__InfluenzaA__ABU80177
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcuccugcaagcggcgcagcaucaaguccuucuucagccggcucaacuggcugcaccagcugaaguacaaguaccccgcccucaacgucacgaugcccaacaacgagaaguucgacaagcuguacaucuggggcgugcaccaccccuccaccgacagcgaccagaucagccuguacgcgcaggccuccgggcgcgugaccgucagcaccaagcggucccagcagacggugaucccgaacaucggcagccgccccugggugcgcggggucuccagccggaucuccaucuacuggaccaucgugaagcccggcgacauccuccugaucaacagcaccggcaaccugaucgcgccccggggguacuucaagauccgcuccggcaagagcuccaucaugcggagcaacgccccgaucgggaagugcaacuccgagugcaucacccccaacggcagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacuccgagggcacggggcaggccgccgaccugaaguccacccaggcggccaucaaccagaucaacggcaagcucaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgccgaggacaugggcaacggcugcuucaagaucuaccacaagugcgacaacgcgugcaucgggagcauccggaacggcaccuacgaccacgacgucuaccgcgacgaggcccugaacaaccgguuccagaucaaggggguggagcucaagagcggcuacaaggacuggauccuguggaucuccuucgccaucagcugcuuccugcugugcgucgugcuccugggguucaucaugugggccugccagaagggcaacauccgcugcaacaucugcaucuga

SEQ ID NO: 62741 - RNA, 1698 nt, Artificial Sequence
  derived and/or modified sequence opt1 from hemagglutinin__InfluenzaA__ABU80298
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucaacaagcuggagcggcgcauggagaaccucaacaagaagguggacgacggcuuccuggacaucuggaccuacaacgcggagcugcucguccugcuggagaacgagcggacccucgacuuccacgacagcaacgugaagaaccuguacaagaaggugaagucccagcugaagaacaacgccaaggagaucgggaacggcugcuucgaguucuaccacaagugcaacaacgagugcauggagagcgucaagaacgggaccuacgacuaccccaaguacuccgaggagagcaagcucaaccgcgagaagaucgacggcgugaagcuggaguccaugggcguguaccagauccuggccaucuacagcacggucgccagcucccucgugcugcuggugagccucggggccaucuccuucuggaugugcagcaacggcucccugcagugccggaucugcaucuga

SEQ ID NO: 62742 - RNA, 1701 nt, Artificial Sequence
  derived and/or modified sequence opt1 from hemagglutinin__InfluenzaA__ABU80320
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggggcaucugcgacagcccccaccagauccuggacggggagaacugcacccugaucgacgcccuccugggcgacccccacugcgacagcuuccagaacaaggagugggaccuguucguggagcgcuccaaggccuacagcaacugcuaccccuacgacgugccggacuacgcgucccuccggagccuggucgccuccagcggcacgcuggaguucaacaacgaguccuucaacuggaccgggguggcccagaacggcaccagcuccgccugcaagcgccggagcaacaaguccuucuucagccgccucaacuggcugcaccagcugaaguacaaguaccccgcgcucaacgugaccaugcccaacaacgagaaguucgacaagcuguacaucuggggcguccaccaccccuccacggacagcgaccagaucagccuguacgcccaggccccggggcgggugaccguguccaccaagcgcagccagcagaccgucauccccaacaucgggucccggcccugggugcgcggcgugagcuccaucaucagcaucuacuggacgaucgucaagcccggcgacauccuccugaucaacugcaccgggaaccugaucgccccgcggggcuacuucaagauccgcuccgggaaguccuccaucaugcggagcgacgccuccaucggcaagugcaacagcgagugcaucacccccaacggcuccauccccaacgacaagcccuuccagaacgugaaccgcaucaccuacggggcgugcccgcgguacgugaagcagaacacgcucaagcuggccaccggcaugcgcaacguccccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaacgggaagcucaaccggcugaucgagaagaccaacgagaaguuccaccagaucgagaaggaguucagcgagguggagggccgcauccaggaccuggagaaguacgucgaggacaccaagaucgaccucugguccuacaacgccgagcugcugguggcccucgagaaccagcacaccaucgaccugacggacagcgagaugaacaagcuguucgagcggaccaagaagcagcuccgcgagaacgcggaggacaugggcaacgggugcuucaagaucuaccacaagugcgacaacgccugcaucggcuccauccggaacgggaccuacgaccacgacguguaccgcgacgaggcccugaacaaccgcuuccagaucaagggcgucgagcucaagagcggguacaaggacuggauccuguggaucagcuucgccaucuccugcuuccugcugugcgugguccuccugggcuucaucaugugggccugccagaagggcaacauccggugcaacaucugcaucuga

SEQ ID NO: 62743 - RNA, 1701 nt, Artificial Sequence; identical to SEQ ID NO: 62047
  derived and/or modified sequence opt1 from hemagglutinin__InfluenzaA__ABU80331

SEQ ID NO: 62744 - RNA, 1701 nt, Artificial Sequence
  derived and/or modified sequence opt1 from hemagglutinin__InfluenzaA__ABU80400
augaaggccauccugcucgugcugcuguacaccuucaccgccgcgaacgccgacacgcucugcaucggcuaccacgccaacaacagcaccgacaccgucgacaccgugcuggagaagaacgugacggucacccacuccgugaaccugcucgaggaccgccacaacgggaagcugugcaagcugcggggcguggcgccccuccaccuggggaagugcaacaucgccggcuggcugcucgggaacccggagugcgagcugcuguucaccgccagcuccuggagcuacaucgucgagaccuccaacagcgacaacggcacgugcuaccccggcgacuucaucaacuacgaggagcuccgcgagcagcuguccagcguguccagcuucgagcgguucgagaucuuccccaaggccuccagcuggcccaaccacgagaccaaccgcggggugaccgccgccugcccguacgcgggcgccaacuccuucuaccggaaccugaucuggcucgucaagaaggggaacagcuaccccaagcuguccaagagcuacgugaacaacaaggagaaggaggugcugguccucuggggcauccaccacccgcccaccuccacggaccagcagagccuguaccagaacgccgacgccuacguguucgugggguccagcaaguacaacaagaaguucaagcccgagaucgccacccgccccaagguccggggccaggcgggccgcaugaacuacuacuggacccugguggagcccggggacaccaucacguucgaggccaccggcaaccucguggucccccgguacgccuucgccaugaagcgcgggagcggcuccggcaucaucaucagcgacaccccggugcacgacugcaacaccacgugccagacccccaagggggccaucaacaccucccugcccuuccagaacauccaccccgugaccaucggcgagugcccgaaguacgucaagagcacgaagcugcggauggcgaccgggcuccgcaacauccccuccauccagagccggggccuguucggggccaucgccggcuucaucgagggcggguggaccggcaugaucgacgggugguacggcuaccaccaccagaacgagcagggguccggcuacgccgccgaccgcaagagcacccagaacgcgaucgacggcaucacgaacaaggugaacuccgugaucgagaagaugaacacccaguucaccgccgucgggaaggaguucaaccaccuggagaagcggaucgagaaccucaaccgcaagguggacgacggcuuccuggacaucuggaccuacaacgccgagcugcucguccugcuggagaacgagcggacgcucgacuaccacgacagcaacgugaagaaccuguacgagaaggugcgcucccagcugaagaacaacgccaaggagaucgggaacggcugcuucgaguucuaccacaagugcgacgacacgugcauggagagcgucaagaacgggaccuacgacuaccccaaguacuccgaggagagcaagcucaaccgggaggagaucgacggcgugaagcuggaguccacccgcaucuaccagauccuggccaucuacagcaccguggcguccagccucguccugcuggugucccucggcgccaucagcuucuggaugugcagcaacgggucccugcagugccggaucugcaucuga

SEQ ID NO: 62745 - RNA, 1701 nt, Artificial Sequence
  derived and/or modified sequence opt1 from hemagglutinin__InfluenzaA__ABU92572
augaagaccaucaucgcccugagcuacauccucugccugguguucacccagaagcugcccggcaacgacaacuccacggccacccucugccuggggcaccacgcggucccgaacggcacccuggugaagaccaucacgaacgaccagaucgaggugaccaacgccaccgagcucguccagagcuccagcaccgggcgcaucugcgacagcccccaccagauccuggacggcgagaacugcacgcugaucgacgcccuccugggggacccccacugcgacggcuuccagaacaaggagugggaccuguucguggagcggagcaaggccuacuccaacugcuaccccuacgacgugccggacuacgucagccuccgcucccugguggccagcuccggcacccuggaguucaacaacgagagcuucaacuggaccgggguggcgcagaacggcaccuccagcgccugcaagcggcgcuccgacaagagcuucuucucccggcucaacuggcugcaccagcugaaguacaaguaccccgcccucaacgucacgaugcccaacaacgagaaguucgacaagcuguacaucuggggcgugcaccaccccgggaccgacagcgaccagaucucccuguacgcccaggcgagcgggcgcgugaccgucagcaccaagcggucccagcagacggugaucccgaacaucggcagccgccccugggugcggggcgucuccagccgcaucuccaucuacuggaccaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucacguacggcccgugcccccgguacgucaagcagaacacccucaagcuggccaccgggaugcgcaacgugcccgagaagcagacccggggcaucuucggggccaucgccggcuucaucgagaacggcugggaggggaugauggacggcugguacggguuccgccaccagaacuccgagggcacggggcaggccgccgaccugaaguccacccaggccgccaucaaccagaucaacggcaagcucaaccggcugaucgagaagaccaacgagaaguuccaccagaucgagaaggaguucuccgagguggagggccgcauccaggaccuggagaaguacgucgaggacaccaagaucgaccucuggagcuacaacgcggagcugcugguggcccucgagaaccagcacacgaucgaccugaccgacuccgagaugaacaagcuguucgagcggaccaagaagcagcuccgcgagaacgccgaggacauggggaacggcugcuucaagaucuaccacaagugcgacaacgccugcaucgggagcauccgcaacggcaccuacgaccacgacguguaccgggacgaggcccugaacaaccgcuuccagaucaagggggucgagcugaaguccggcuacaaggacuggauccucuggaucagcuucgcgaucagcugcuuccugcugugcaucgugcuccugggcuucaucaugugggccugccagaaggggaacauccggugcaacaucugcaucuga

SEQ ID NO: 62746 - RNA, 1701 nt, Artificial Sequence
  derived and/or modified sequence opt1 from hemagglutinin__InfluenzaA__ABU92573
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccuccugaucaacagcaccggcaaccugaucgcgccccggggguacuucaagauccgcuccggcaagagcuccaucaugcggagcgacgccccgaucggcaagugcaacuccgagugcaucacccccaacgggagcauccccaacggcaagcccuuccagaacgugaaccgcaucaccuacggggccugcccgcgguacgucaagcagaacacgcucaagcuggccaccggcaugcgcaacgugcccgagaagcagacccgggggaucuucggcgccaucgccggcuucaucgagaacgggugggagggcaugauggacgggugguacggcuuccgccaccagaacuccgaggggaccggccaggccgccgaccugaaguccacgcaggcggccaucaaccagaucaacggcaagcucaaccggcugaucaagaagaccaacgagaaguuccaccagaucgagaaggaguucuccgagguggaggggcgcauccaggaccuggagaaguacgucgaggacaccaagaucgaccucuggagcuacaacgccgagcugcugguggcccucgagaaccagcacaccaucgaccugacggacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggcuacaaggacuggauccucuggaucagcuucgccaucagcugcuuccugcugugcaucgugcuccugggguucaucaugugggccugccagaagggcaacauccggugcaacaucugcaucuga

SEQ ID NO: 62747 - RNA, 1701 nt, Artificial Sequence
  derived and/or modified sequence opt1 from hemagglutinin__InfluenzaA__ABU92575
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagcaagcccugggugcgcggcgucuccagccggaucuccaucuacuggacgaucgugaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcccgugcccccgcuacgucaagcagaacacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggccgcgaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgccugcaucgggagcauccgcaacggcaccuacgaccacgacguguaccgcgacgaggcgcugaacaaccgguuccagaucaagggggucgagcugaaguccggcuacaaggacuggauccucuggaucagcuucgccaucagcugcuuccugcugugcaucgugcuccugggcuucaucaugugggccugccagaaggggaacauccgcugcaacaucugcaucuga

SEQ ID NO: 62748 - RNA, 1701 nt, Artificial Sequence; identical to SEQ ID NO: 61059
  derived and/or modified sequence opt1 from hemagglutinin__InfluenzaA__ABU92576

SEQ ID NO: 62749 - RNA, 1701 nt, Artificial Sequence; identical to SEQ ID NO: 61059
  derived and/or modified sequence opt1 from hemagglutinin__InfluenzaA__ABU92577

SEQ ID NO: 62750 - RNA, 1701 nt, Artificial Sequence; identical to SEQ ID NO: 61080
  derived and/or modified sequence opt1 from hemagglutinin__InfluenzaA__ABU92578

SEQ ID NO: 62751 - RNA, 1701 nt, Artificial Sequence; identical to SEQ ID NO: 61080
  derived and/or modified sequence opt1 from hemagglutinin__InfluenzaA__ABU92579

SEQ ID NO: 62752 - RNA, 1701 nt, Artificial Sequence; identical to SEQ ID NO: 61080
  derived and/or modified sequence opt1 from hemagglutinin__InfluenzaA__ABU92580

SEQ ID NO: 62753 - RNA, 1701 nt, Artificial Sequence; identical to SEQ ID NO: 62745
  derived and/or modified sequence opt1 from hemagglutinin__InfluenzaA__ABU92581

SEQ ID NO: 62754 - RNA, 1701 nt, Artificial Sequence
  derived and/or modified sequence opt1 from hemagglutinin__InfluenzaA__ABU92582
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccagaacgucaccaugcccaacaacgagaaguucgacaagcucuacaucuggggcgugcaccaccccgggacggacagcgaccagaucucccuguacgcgcaggccagcgggcgcgugaccgucagcaccaagcggucccagcagaccgugaucccgaacaucggcagccgccccugggugcggggcgucuccagccgcaucuccaucuacuggacgaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgugaaccgcaucaccuacggcgccugcccgcgguacgucaagcagaacacgcugaagcucgccaccgggaugcgcaacgugcccgagaagcagacccggggcaucuucggggccaucgccggcuucaucgagaacggcugggaggggaugauggacggcugguacggguuccgccaccagaacuccgagggcaccgggcaggccgccgaccugaaguccacgcaggcggccaucaaccagaucaacggcaagcugaaccggcucaucgagaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacaccaucgaccucacggacuccgagaugaacaagcuguucgagcggaccaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucagcugcuuccuccugugcaucgugcugcucggcuucaucaugugggccugccagaaggggaacauccggugcaacaucugcaucuga

SEQ ID NO: 62755 - RNA, 1701 nt, Artificial Sequence; identical to SEQ ID NO: 62754
  derived and/or modified sequence opt1 from hemagglutinin__InfluenzaA__ABU92583

SEQ ID NO: 62756 - RNA, 1701 nt, Artificial Sequence
  derived and/or modified sequence opt1 from hemagglutinin__InfluenzaA__ABU92584
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugcgcuacaaguaccccgcccucaacgucaccaugcccaacaacgagaaguucgacaagcuguacaucuggggcgugcaccaccccgggacggacagcgaccagaucucccuguacgcgcaggccagcgggcgggugaccgucagcaccaagcgcucccagcagaccgugaucccgaacaucggcagccggcccugggugcgcggcgucuccagccggaucuccaucuacuggacgaucgugaagcccggggacauccuccugaucaacagcaccggcaaccugaucgcgccccgcggguacuucaagauccgguccggcaagagcuccaucaugcgcagcgacgccccgaucggcaagugcaacuccgagugcaucacccccaacgggagcauccccaacgacaagcccuuccagaacgugaaccggaucaccuacggcgccugcccgcgcuacgucaagcagaagacgcucaagcuggccaccgggaugcggaacgugcccgagaagcagacccgcggcaucuucggggccaucgccggcuucaucgagaacggcugggaggggaugauggacggcugguacggguuccggcaccagaacuccgagggcaccgggcaggccgccgaccugaaguccacgcaggcggccaucaaccagaucaacggcaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgcgagaacgccgaggacauggggaacggcugcuucaagaucuaccacaagugcgacaacgcgugcaucgggagcauccggaacggcaccuacgaccacgacguguaccgcgacgaggcccugaacaaccgguuccagaucaagggggucgagcugaaguccggcuacaaggacuggauccucuggaucagcuucgccaucagcugcuuccugcugugcaucgugcuccugggcuucaucaugugggccugccagaaggggaacauccgcugcaacaucugcaucuga

SEQ ID NO: 62757 - RNA, 1701 nt, Artificial Sequence
  derived and/or modified sequence opt1 from hemagglutinin__InfluenzaA__ABU92586
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccgacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaagaacuggauccuguggaucuccuucgccaucagcugcuuccuccugugcguggcccugcucggguucaucaugugggccugccagaagggcaacauccggugcaacaucugcaucuga

SEQ ID NO: 62758 - RNA, 1701 nt, Artificial Sequence
  derived and/or modified sequence opt1 from hemagglutinin__InfluenzaA__ABU92587
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgccaucccgaacaucggcagccggccccgcgugcgggacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgucaaccgcaucaccuacggcgcgugcccccgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaucgggcaggccgcggaccugaaguccacccaggccgccaucgaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacacgaucgaccucaccgacagcgagaugaacaagcuguucgagcggaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggcgugccagaagggcaacauccggugcaacaucugcaucuga

SEQ ID NO: 62759 - RNA, 1701 nt, Artificial Sequence
  derived and/or modified sequence opt1 from hemagglutinin__InfluenzaA__ABU92588
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcaaguccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccgcaucaccgugagcacgaagcggagccagcagaccgugaucccgaacaucggcucccgcccccggguccgcgacauccccagccggaucuccaucuacuggaccaucgugaagcccggggacauccugcucaucaacagcaccggcaaccugaucgccccgcgcggguacuucaagauccgguccggcaagagcuccaucaugcgcagcgacgcccccaucggcaagugcaacuccgagugcaucacgcccaacgggagcauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggcaucgggcaggccgccgaccucaagagcacccaggcggccaucaaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggagcuacaacgccgaguuccucguggcccuggagaaccagcacacgaucgaccugaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggaccuacgaccacgacgucuaccgcgacgaggcccugaacaaccgguuccagaucaagggcguggagcucaaguccggcuacaaggacuggauccuguggaucagcuucgccaucuccugcuuccugcucugcguggcccugcugggguucaucaugugggccugccagaagggcaacauccgcugcaacaucugcaucuga

SEQ ID NO: 62760 - RNA, 1701 nt, Artificial Sequence; identical to SEQ ID NO: 61641
  derived and/or modified sequence opt1 from hemagglutinin__InfluenzaA__ABU92590

SEQ ID NO: 62761 - RNA, 1701 nt, Artificial Sequence
  derived and/or modified sequence opt1 from hemagglutinin__InfluenzaA__ABU92591
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccgacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62762 - RNA, 1701 nt, Artificial Sequence; identical to SEQ ID NO: 62761
  derived and/or modified sequence opt1 from hemagglutinin__InfluenzaA__ABU92592

SEQ ID NO: 62763 - RNA, 1701 nt, Artificial Sequence
  derived and/or modified sequence opt1 from hemagglutinin__InfluenzaA__ABU92593
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccggccagaaggggaacaagcgcugcaacaucugcaucuga

SEQ ID NO: 62764 - RNA, 1701 nt, Artificial Sequence
  derived and/or modified sequence opt1 from hemagglutinin__InfluenzaA__ABU92594
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagagcugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugagcggcuucaucaugugggccugccagaaggggaacauccggugcaacaucugcaucuga

SEQ ID NO: 62765 - RNA, 1701 nt, Artificial Sequence
  derived and/or modified sequence opt1 from hemagglutinin__InfluenzaA__ABU92595
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgggaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 62766 - RNA, 1701 nt, Artificial Sequence
  derived and/or modified sequence opt1 from hemagglutinin__InfluenzaA__ABU92596
augaagaccaucaucgcccugagcuacauccucugccugguguucgcccagaagcugcccggcaacgacaacuccaccgcgacgcucugccuggggcaccacgccgucccgaacggcaccauggugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucaucgccagcuccggcacgcuggaguucaacaacgagagcuucaacuggaccggggucacccagaacggcaccuccagcgccugcaagcgccgguccgacaacagcuucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucagccuguacgcgcaggccuccgggcggaucaccgucagcacgaagcgcagccagcagaccgugaucccgaacaucggcucccggccccgcgugcgggacauccccagccgcaucuccaucuacuggaccaucgucaagcccggcgacauccugcucaucaacagcaccgggaaccugaucgccccgcggggcuacuucaagauccgcuccgggaaguccuccaucaugcggagcgacgcccccaucggcaagugcaacuccggcugcaucacgcccaacgggagcauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucgaccagaucaacggcaagcugaaccggcugaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 62767 - RNA, 1701 nt, Artificial Sequence; identical to SEQ ID NO: 61638
  derived and/or modified sequence opt1 from hemagglutinin__InfluenzaA__ABU92597

SEQ ID NO: 62768 - RNA, 1701 nt, Artificial Sequence; identical to SEQ ID NO: 61081
  derived and/or modified sequence opt1 from hemagglutinin__InfluenzaA__ABU92601

SEQ ID NO: 62769 - RNA, 1701 nt, Artificial Sequence; identical to SEQ ID NO: 61081
  derived and/or modified sequence opt1 from hemagglutinin__InfluenzaA__ABU92602

SEQ ID NO: 62770 - RNA, 1701 nt, Artificial Sequence
  derived and/or modified sequence opt1 from hemagglutinin__InfluenzaA__ABU92603
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucgacuggaccggggugacccagaacggcaccagcuccgccugcaagcgccggagcgacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccgggcggaucaccgugagcacgaagcgcagccagcagaccgugaucccgaacaucggcucccggccccgcguccgggacgugagcucccgcaucagcaucuacuggaccaucgugaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggaccggccaggccgccgaccugaaguccacccaggcggccaucaaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcucaagagcggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 62771 - RNA, 1701 nt, Artificial Sequence; identical to SEQ ID NO: 61081
  derived and/or modified sequence opt1 from hemagglutinin__InfluenzaA__ABU92604

SEQ ID NO: 62772 - RNA, 1701 nt, Artificial Sequence; identical to SEQ ID NO: 62770
  derived and/or modified sequence opt1 from hemagglutinin__InfluenzaA__ABU92605

SEQ ID NO: 62773 - RNA, 1701 nt, Artificial Sequence; identical to SEQ ID NO: 62770
  derived and/or modified sequence opt1 from hemagglutinin__InfluenzaA__ABU92606

SEQ ID NO: 62774 - RNA, 1701 nt, Artificial Sequence; identical to SEQ ID NO: 61620
  derived and/or modified sequence opt1 from hemagglutinin__InfluenzaA__ABU92608

SEQ ID NO: 62775 - RNA, 1701 nt, Artificial Sequence; identical to SEQ ID NO: 61620
  derived and/or modified sequence opt1 from hemagglutinin__InfluenzaA__ABU92609

SEQ ID NO: 62776 - RNA, 1701 nt, Artificial Sequence
  derived and/or modified sequence opt1 from hemagglutinin__InfluenzaA__ABU92610
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcacagcaaguucaaguaccccgcccugaacgugaccaugcccaacaacgagaaguucgacaagcuguacaucuggggcguccaccaccccgggaccgacaacgaccagaucuuccucuacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcugaucaacagcaccgggaaccucaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucgccuacggggcgugcccccgguacgucaagcagaacacccugaagcuggccaccggcaugcgcaacgugcccgagaagcagacccgggggaucuucggcgccaucgccggguucaucgagaacggcugggagggcaugguggacgggugguacggcuuccgccaccagaacuccgaggggaucggccaggccgcggaccucaagagcacgcaggccgccaucaaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagcggaccaagaagcagcuccgcgagaacgcggaggacaugagcaacgggugcuucaagaucuaccacaagugcgacaacgccugcaucggcuccauccgcaacgggaccuacgaccacgacgucuaccgggacgaggcccugaacaaccgcuuccagaucaagggcguggagcucaagagcggguacaaggacuggauccuguggaucuccuucgccaucagcugcuuccugcucugcgugguccugcugggcuucaucaugugggccugccagaagggcaacauccggugcaacaucugcaucuga

SEQ ID NO: 62777 - RNA, 1701 nt, Artificial Sequence
  derived and/or modified sequence opt1 from hemagglutinin__InfluenzaA__ABU92611
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucagccuguacgcgcaggccuccggcaagaucaccgucagcacgaagcggagccagcagaccgugaucccgaacaucggcucccgcccccgggugcgcgacauccccagccggaucuccaucuacuggaccaucgucaagcccggggacauccugcucaucaacagcaccggcaaccugaucgccccgcgcggguacuucaagauccgguccggcaagagcuccaucaugcgcagcgacgcccccaucggcaagugcaacuccgagugcaucacgcccaacgggagcauccccaacgacaagccguuccagaacgugaaccggaucaccuacggcgccugcccccgcuacgugaagcagaacacccugaagcucgcgaccgggaugcggaacguccccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucgaccagaucaacggcaagcugaaccgccucaucggcaagaccaacgagaaguuccaccagaucgagaaggaguucuccgagguggaggggcggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggaccuacgaccacgacguguaccgcgacgaggcccucaacaaccgguuccagaucaagggcgucgagcugaaguccggcuacaaggacuggauccuguggaucagcuucgccaucuccugcuuccuccugugcguggcccugcucggguucaucaucugggccugccugaagggcaacauccgcugcaacaucugcaucuga

SEQ ID NO: 62778 - RNA, 1701 nt, Artificial Sequence
  derived and/or modified sequence opt1 from hemagglutinin__InfluenzaA__ABU92612
augaagaccaucaucgcccugagcuacauccucugccugguguucgcccagaagcugcccggcaacgacaacuccaccgcgacgcucugccuggggcaccacgccgucccgaacggcaccauggugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggcccacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacaacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 62779 - RNA, 1701 nt, Artificial Sequence; identical to SEQ ID NO: 62266
  derived and/or modified sequence opt1 from hemagglutinin__InfluenzaA__ABU92613

SEQ ID NO: 62780 - RNA, 1701 nt, Artificial Sequence; identical to SEQ ID NO: 62765
  derived and/or modified sequence opt1 from hemagglutinin__InfluenzaA__ABU92614

SEQ ID NO: 62781 - RNA, 1701 nt, Artificial Sequence
  derived and/or modified sequence opt1 from hemagglutinin__InfluenzaA__ABU92615
augaagaccaucaucgcccugagcuacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcggagcaaggccuacuccaacugcuaccccuacgacgugccggacuacgcgagccugcgcucccucgucgccagcuccgggacgcuggaguucaacaacgagagcuucaacuggaccggcgugacccagaacgggaccuccagcgccugcaagcggcgcuccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccgcaucaccgugagcacgaagcggagccagcagaccgugaucccgaacgucggcucccgcccccgggugcgcgacauccccagccggaucuccaucuacuggaccaucgugaagcccggggacauccugcucaucaacagcaccggcaaccugaucgccccgcgcggguacuucaagauccgguccggcaagagcuccaucaugcgcagcgacgcccccaucggcaagugcaacuccgagugcaucacgcccaacgggagcauccccaacgacaagccguuccagaacgucaaccggaucaccuacggcgccugcccccgcuacgugaagcagaacacccugaagcucgcgaccgggaugcggaacgugcccgagaagcagacgcgcggcaucuucggggccaucgccggcuucaucgagaacggcugggaggggauggucgacggcugguacggguuccggcaccagaacuccgagggcaucgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacaccaagaucgaccuguggagcuacaacgccgagcuccuggucgcccuggagaaccagcacacgaucgaccucaccgacuccgagaugaacaagcuguucgagcgcaccaagaagcagcugcgcgagaacgccgaggacaugggcaacgggugcuucaagaucuaccacaagugcgacaacgcgugcaucggcagcauccggaacgggaccuacgaccacgacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 62782 - RNA, 1701 nt, Artificial Sequence
  derived and/or modified sequence opt1 from hemagglutinin__InfluenzaA__ABU92617
augaagaccaucaucgcccugagcuacauccucugccugguguucgcccagaagcugcccggcaacgacaacuccaccgcgacgcucugccuggggcaccacagcgucccgaacggcaccaucgugaagaccaucaccaacgaccagaucgaggugacgaacgccaccgagcugguccaguccagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgccucccugcggagccucaucgcguccagcgggacgcuggaguucaacaacgaguccuucaacuggaccggcgucacccagaacgggaccagcuccgccugcaagcgccggagcaacuccagcuucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucagccuguacgcccaggcgagcggccggaucaccgucuccacgaagcgcagccagcagaccgugaucccgaacaucggcucccggccccgcgugcgggacauccccagccgcaucuccaucuacuggaccaucgucaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgugaagcagaacacccugaagcucgccaccgggaugcgcaacguccccgagaagcagacgcggggcaucuucggggcgaucgccggcuucaucgagaacggcugggaggggaugguggacggcugguacggguuccgccaccagaacuccgagggcaucgggcaggccgccgaccucaagagcacccaggccgcgaucgaccagaucaacggcaagcugaaccggcugaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 62783 - RNA, 1701 nt, Artificial Sequence; identical to SEQ ID NO: 62266
  derived and/or modified sequence opt1 from hemagglutinin__InfluenzaA__ABU92619

SEQ ID NO: 62784 - RNA, 1701 nt, Artificial Sequence; identical to SEQ ID NO: 62765
  derived and/or modified sequence opt1 from hemagglutinin__InfluenzaA__ABU92620

SEQ ID NO: 62785 - RNA, 1701 nt, Artificial Sequence
  derived and/or modified sequence opt1 from hemagglutinin__InfluenzaA__ABU92622
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccgacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccggagcgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucgaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucagcugcuuccuccugugcguggcccugcucggguucaucaugugggccugccagaagggcaacauccggugcaacaucugcaucuga

SEQ ID NO: 62786 - RNA, 1701 nt, Artificial Sequence; identical to SEQ ID NO: 61081
  derived and/or modified sequence opt1 from hemagglutinin__InfluenzaA__ABU92623

SEQ ID NO: 62787 - RNA, 1701 nt, Artificial Sequence
  derived and/or modified sequence opt1 from hemagglutinin__InfluenzaA__ABU92624
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucgacuggaccggggugacccagaacggcaccagcuccgccugcaagcgccggagcgacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggcccuggggcggaucaccguguccacgaagcgcagccagcagaccgugaucccgaacaucggcagccggccccgcguccgggacguguccagccgcaucuccaucuacuggaccaucgugaagcccggcgacauccuccugaucaacagcaccgggaaccugaucgcgccccggggcuacuucaagauccgcuccggcaagagcuccaucaugcggagcgacgccccgaucgggaagugcaacuccgagugcaucacgcccaacggcagcauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacguggaggacacgaagaucgaccucuggagcuacaacgccgagcugcuggucgcccucgagaaccagcacaccaucgaccugaccgacuccgagaugaacaagcuguucgagcggaccaagaagcagcuccgcgagaacgccgaggacauggggaacggcugcuucaagaucuaccacaagugcgacaacgcgugcaucgggagcauccgcaacggcacguacgaccacgacguguaccgggacgaggcccugaacaaccgcuuccagaucaaggggguggagcugaaguccggcuacaaggacuggauccucuggaucagcuucgccaucuccugcuuccugcugugcgucgcccuccugggcuucaucaugugggccugccagaaggggaacauccggugcaacaucugcaucuga

SEQ ID NO: 62788 - RNA, 1701 nt, Artificial Sequence; identical to SEQ ID NO: 62770
  derived and/or modified sequence opt1 from hemagglutinin__InfluenzaA__ABU92625

SEQ ID NO: 62789 - RNA, 1701 nt, Artificial Sequence; identical to SEQ ID NO: 61081
  derived and/or modified sequence opt1 from hemagglutinin__InfluenzaA__ABU92626

SEQ ID NO: 62790 - RNA, 1701 nt, Artificial Sequence
  derived and/or modified sequence opt1 from hemagglutinin__InfluenzaA__ABU92627
augaagaccaucaucgcccugagcuacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagaucagcuccaccggggagaucugcgacagcccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucgacuggaccggggugacccagaacggcaccagcuccgccugcaagcgccggagcgacaaguccuucuucagccgccugaacuggcugacgcaccucaaguacaaguaccccgcccugaacgugaccaugcccaacaacgagaaguucgacaagcuguacaucuggggcguccaccaccccgggaccgacuccgaccagaucagccucuacgcgcaggccuccgggcggaucaccgugagcacgaagcgcagccagcagaccgugaucccgaacaucggcucccggccccgcguccgggacgugagcucccgcaucagcaucuacuggaccaucgugaagcccggcgacauccugcugaucaaccggcccgggaaccucaucgccccgcgcggcuacuucaagauccgguccggcaagagcuccaucaugcgcagcgacgcccccaucgggaagugcaacuccgagugcaucacccccaacggcagcauccccaacgacaagccguuccagaacgucaaccggaucacguacggggccugcccccgcuacgugaagcagaacacccugaagcuggcgaccggcaugcggaacgugcccgagaagcagacccgcgggaucuucggcgccaucgccggguucaucgagaacggcugggagggcauggucgacgggugguacggcuuccggcaccagaacuccgaggggacgggccaggccgccgaccucaagagcacccaggcggccaucaaccagaucaacgggaagcugaaccgccugaucggcaagaccaacgagaaguuccaccagaucgagaaggaguucuccgagguggagggccggauccaggaccucgagaaguacguggaggacaccaagaucgaccuguggagcuacaacgccgagcugcucgucgcccuggagaaccagcacacgaucgaccugaccgacuccgagaugaacaagcuguucgagcgcaccaagaagcagcuccgcgagaacgccgaggacauggggaacggcugcuucaagaucuaccacaagugcgacaacgcgugcaucgggagcauccggaacggcaccuacgaccacgacguguaccgcgacgaggcccugaacaaccgguuccagaucaaggggguggagcucaaguccggcuacaaggacuggauccuguggaucagcuucgccaucuccugcuuccugcucugcgucgcccugcugggcuucaucaugugggccugccagaaggggaacauccgcugcaacaucugcaucuga

SEQ ID NO: 62791 - RNA, 1701 nt, Artificial Sequence; identical to SEQ ID NO: 62770
  derived and/or modified sequence opt1 from hemagglutinin__InfluenzaA__ABU92628

SEQ ID NO: 62792 - RNA, 1701 nt, Artificial Sequence; identical to SEQ ID NO: 62770
  derived and/or modified sequence opt1 from hemagglutinin__InfluenzaA__ABU92631

SEQ ID NO: 62793 - RNA, 1701 nt, Artificial Sequence
  derived and/or modified sequence opt1 from hemagglutinin__InfluenzaA__ABU92632
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcgugcaccaccccgggaccgacagcgaccagaucucccuguacgcgcaggccagcggccggaucaccgucagcacgaagcgcucccagcagaccgugaucccgaacaucggcagccggccccgcgugcgggacgucuccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccugaacuccgagggcaccgggcaggccgccgaccugaaguccacccaggcggccaucaaccagaucaacggcaagcucaaccggcugaucggcaagaccaacgagaaguuccaccagaucgagaaggaguucuccgaggucgaggggcgcauccaggaccuggagaaguacguggaggacacgaagaucgaccucuggagcuacaacgccgagcugcugguggcccucgagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggacguacgaccacgacgucuaccgggacgaggcccugaacaaccgcuuccagaucaagggcguggagcugaaguccggcuacaaggacuggauccucuggaucagcuucgccaucagcugcuuccugcugugcguggcccuccugggguucaucaugugggccugccagaagggcaacauccggugcaacaucugcaucuga

SEQ ID NO: 62794 - RNA, 1701 nt, Artificial Sequence
  derived and/or modified sequence opt1 from hemagglutinin__InfluenzaA__ABU92635
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcgguccaucgucgccagcuccgggacgcucgaguucaacaacgagagcuucaacuggaccggcgugacccagaacgggaccuccagcgccugcaagcgcaaguccaacaagagcuucuucucccggcugaacuggcugacgcaccucaaguacaaguaccccgcccugaacgugaccaugcccaacaacgagaaguucgacaagcuguacaucuggggcguccaccaccccgggaccgacaacgaccagaucagccucuacgcgcaggccuccggccgcaucaccgugagcacgaagcggagccagcagaccgugaucccgaacaucggcucccgcccccggguccgcgacgugagcucccggaucagcaucuacuggaccaucgugaagcccggggacauccugcugaucaacuccaccggcaaccucaucgcgccccgcggguacuucaagauccggagcggcaaguccagcaucaugcgcuccgacgccccgaucggcaagugcaacagcgagugcaucacgcccaacggguccauccccaacgacaagcccuuccagaacgucaaccggaucaccuacggcgccugcccgcgcuacgugaagcagaacacccugaagcuggccaccgggaugcggaacgugcccgagaagcagacgcgcggcaucuucggggccaucgccggcuucaucgagaacggcugggaggggauggucgacggcugguacggguuccggcaccagaacagcgagggcaccgggcaggccgccgaccucaaguccacccaggcggccaucaaccagaucaacggcaagcugaaccgccugaucggcaagaccaacgagaaguuccaccagaucgagaaggaguucagcgagguggaggggcggauccaggaccucgagaaguacguggaggacacgaagaucgaccugugguccuacaacgccgagcugcucgucgcccuggagaaccagcacaccaucgaccugaccgacagcgagaugaacaagcuguucgagcgcaccaagaagcagcuccgggagaacgccgaggacaugggcaacgggugcuucaagaucuaccacaagugcgacaacgcgugcaucggcuccauccgcaacgggacguacgaccacgacguguaccgcgacgaggcccugaacaaccgguuccagaucaagggcguggagcucaagagcggcuacaaggacuggauccuguggaucuccuucgccaucagcugcuuccugcucugcgucgcccugcugggguucaucaugugggccugccagaagggcaacauccgcugcaacaucugcaucuga

SEQ ID NO: 62795 - RNA, 1701 nt, Artificial Sequence; identical to SEQ ID NO: 61638
  derived and/or modified sequence opt1 from hemagglutinin__InfluenzaA__ABU92636

SEQ ID NO: 62796 - RNA, 1701 nt, Artificial Sequence
  derived and/or modified sequence opt1 from hemagglutinin__InfluenzaA__ABU92637
augaagaccaucaucgcccugagcuacauccucugccugguguucgcccagaagcugcccggcaacgacaacuccaccgcgacgcucugccuggggcaccacgccgucccgaacggcaccaccgugaagaccaucacgaacgaccagaucgaggugaccaacgccaccgagcugguccagagcuccagcaccgggggcaucugcgacagcccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgucagccugcggucccucguggcgagcuccgggacccuggaguucaacaacgagagcuucaacuggaccggcgugacccagaacgggacguccagcgccugcaagcgccgguccaacaacagcuucuucucccgccugaacuggcucacccaccugaaguucaaguaccccgcccugaacgucaccaugcccaacaacgagaaguucgacaagcucuacaucuggggcgugcaccaccccgggaccgacaacgaccagaucagccuguacgcccaggcguccggccggaucacggugagcaccaagcgcagccagcagaccgucaucccgaacaucggcucccggccccgcgugcgggacauccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgucaaccgcaucaccuacggcgccugcccccgguacgugaagcagaacacccugaagcucgccacggggaugcgcaacgugcccgagaagcagacccggggcaucuucggggcgaucgccggcuucaucgagaacggcugggaggggauggucgacggcugguacggguuccgccaccagaacuccgagggcaucgggcaggccgccgaccugaaguccacccaggccgcgaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgccugcaucggcagcauccgcaacgggacguacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 62797 - RNA, 1701 nt, Artificial Sequence
  derived and/or modified sequence opt1 from hemagglutinin__InfluenzaA__ABU92639
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacacgaagugggaccuguucguggagcgcuccaaggccuacagcaacugcuaccccuacgacgugccggacuacgcgucccugcggagccucgucgccuccagcggcacccuggaguucaacaacgaguccuucgacuggaccggggugacccagaacggcacgagcuccgccugcaagcgccggagcgacaaguccuucuucagccgccugaacuggcucacccaccugaaguacaaguaccccgcccugaacgugaccaugcccaacaacgagaaguucgacaagcucuacaucuggggcguccaccaccccgggaccgacuccgaccagaucagccuguacgcgcaggccuccgggcggaucacggugagcaccaagcgcagccagcagaccgugaucccgaacaucggcucccggccccgcguccgggacgugagcucccgcaucagcaucuacuggaccaucgugaagcccggcgacauccugcucaucaacuccacggggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgucaaccgcaucaccuacggggccugcccgcgguacgugaagcagaacacccugaagcucgccacgggcaugcgcaacgugcccgagaagcagacccgggggaucuucggcgccaucgccggguucaucgagaacggcugggagggcauggucgacgggugguacggcuuccgccaccagaacagcgaggggaccggccaggccgccgaccugaaguccacccaggcggccaucaaccagaucaacgggaagcugaaccggcucaucggcaagacgaacgagaaguuccaccagaucgagaaggaguucagcgagguggagggccgcauccaggaccuggagaaguacaucgaggacaccaagaucgaccugugguccuacaacgccgagcuccugguggcccuggagaaccagcacaccaucgaccucaccgacagcgagaugaacaagcuguucgagcggacgaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcucaagagcggcuacaaggacuggauccuguggaucuccuucgccaucagcugcuuccugcugugcguggcccugcucggcuucaucaugugggccugccagaaggggaacauccggugcaacaucugcaucuga

SEQ ID NO: 62798 - RNA, 1701 nt, Artificial Sequence
  derived and/or modified sequence opt1 from hemagglutinin__InfluenzaA__ABU92640
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgccgcccugcucggcuucaucaugugggcgugccagaaggggaacauccggugcaacaucugcaucuga

SEQ ID NO: 62799 - RNA, 1701 nt, Artificial Sequence
  derived and/or modified sequence opt1 from hemagglutinin__InfluenzaA__ABU92641
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcaaguccaacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccgcaucaccgugagcacgaagcggagccagcagaccgugaucccgaacaucggcucccgcccccggguccgcgacauccccagccggaucuccaucuacuggaccaucgugaagcccggggacauccugcucaucaacagcaccggcaaccugaucgccccgcgcggguacuucaagauccgguccggcaagagcuccaucaugcgcagcgacgcccccaucggcaagugcaacuccgagugcaucacgcccaacgggagcauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacuccgagggcaucgggcaggccgccgaccugaaguccacccaggcggccaucaaccagaucaacggcaagcugaaccgccucaucggcaagaccaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacaugggcaacgggugcuucaagaucuaccacaagugcgacaacgcgugcaucggcagcauccgcaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 62800 - RNA, 1701 nt, Artificial Sequence
  derived and/or modified sequence opt1 from hemagglutinin__InfluenzaA__ABU92642
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaucguguccaccaagcgcagccagcagacggugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacccccaacggguccauccccaacgacaagccguuccagaacgugaaccgcaucacguacggcgccugcccccgguacgucaagcagaacacccugaagcucgcgaccgggaugcgcaacgugcccgagaagcagacccggggcaucuucggggccaucgccggcuucaucgagaacggcugggaggggaugguggacggcugguacggguuccgccaccagaacagcgagggcaucgggcaggccgccgaccugaaguccacgcaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 62801 - RNA, 1701 nt, Artificial Sequence
  derived and/or modified sequence opt1 from hemagglutinin__InfluenzaA__ABU92643
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucgacuggaccggggugacccagaacggcaccagcuccgccugcaagcgccggagcgacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccgggcggaucaccgugagcacgaagcgcagccagcagaccgugaucccgaacaucggcucccggccccgcguccgggacgugagcucccgcaucagcaucuacuggaccaucgugaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggaccggccaggccgccgaccugaaguccacccaggcggccaucaaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacaacguguaccgggacgaggcccucaacaaccgcuuccagaucaaggggguggagcucaagagcggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 62802 - RNA, 1701 nt, Artificial Sequence
  derived and/or modified sequence opt1 from hemagglutinin__InfluenzaA__ABU92645
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucgccuacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggaucggccaggccgcggaccugaaguccacgcaggccgccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacagcgagaugaacaagcuguucgagcggaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggaucgagcugaaguccggcuacaaggacuggauccuguggaucuccuucgccaucagcugcuuccuccugugcguggugcugcucggcuucaucaugugggccugccagaaggggaacauccggugcaacaucugcaucuga

SEQ ID NO: 62803 - RNA, 1701 nt, Artificial Sequence
  derived and/or modified sequence opt1 from hemagglutinin__InfluenzaA__ABU92646
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugcccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 62804 - RNA, 1701 nt, Artificial Sequence; identical to SEQ ID NO: 61081
  derived and/or modified sequence opt1 from hemagglutinin__InfluenzaA__ABU92647

SEQ ID NO: 62805 - RNA, 1701 nt, Artificial Sequence
  derived and/or modified sequence opt1 from hemagglutinin__InfluenzaA__ABU92648
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcaagcgccggagcgacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccgggcggaucaccgugagcacgaagcgcagccagcagaccgugaucccgaacaucggcucccggccccgcguccgggacgugagcucccgcaucagcaucuacuggaccaucgugaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggaccggccaggccgccgaccugaaguccacccaggcggccaucaaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcucaagagcggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 62806 - RNA, 1701 nt, Artificial Sequence; identical to SEQ ID NO: 61081
  derived and/or modified sequence opt1 from hemagglutinin__InfluenzaA__ABU92649

SEQ ID NO: 62807 - RNA, 1701 nt, Artificial Sequence; identical to SEQ ID NO: 62770
  derived and/or modified sequence opt1 from hemagglutinin__InfluenzaA__ABU92650

SEQ ID NO: 62808 - RNA, 1701 nt, Artificial Sequence
  derived and/or modified sequence opt1 from hemagglutinin__InfluenzaA__ABU92651
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucuacaacgaguccuucgacuggaccggggugacccagaacggcaccagcuccgccugcaagcgccggagcgacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccgggcggaucaccgugagcacgaagcgcagccagcagaccgugaucccgaacaucggcucccggccccgcguccgggacgugagcucccgcaucagcaucuacuggaccaucgugaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggaccggccaggccgccgaccugaaguccacccaggcggccaucaaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcucaagagcggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 62809 - RNA, 1701 nt, Artificial Sequence
  derived and/or modified sequence opt1 from hemagglutinin__InfluenzaA__ABU92652
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaucggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 62810 - RNA, 1701 nt, Artificial Sequence; identical to SEQ ID NO: 62770
  derived and/or modified sequence opt1 from hemagglutinin__InfluenzaA__ABU92653

SEQ ID NO: 62811 - RNA, 1701 nt, Artificial Sequence
  derived and/or modified sequence opt1 from hemagglutinin__InfluenzaA__ABU92654
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggcaagaucaccgugagcacgaagcggagccagcagaccgugaucccgaacaucggcucccgcccccggguccgcgacgugcccagccggaucuccaucuacuggaccaucgugaagcccggggacauccugcucaucaacagcaccggcaaccugaucgccccgcgcggguacuucaagauccgguccggcaagagcuccaucaugcgcagcgacgcccccaucggcaagugcaacuccgagugcaucacgcccaacgggagcauccugaacgacaagcccuuccagaacgucaaccggaucaccuacggcgccugcccgcgcuacgugaagcagaacacccucaagcuggcgaccgggaugcggaacgugcccgagaagcagacgcgcggcaucuucggggccaucgccggcuucaucgagaacggcugggaggggauggucgacggcugguacggguuccggcaccagaacgccgagggcaccgggcaggccgcggaccugaaguccacccaggccgccaucaaccagaucaacggcaagcucaaccgccugaucggcaagaccaacgagaaguuccaccagaucgagaaggaguucagcgagguggaggggcggauccaggaccuggagaaguacguggaggacacgaagaucgaccucugguccuacaacgccgagcugcuggucgcccucgagaaccagcacaccaucgaccugaccgacagcgagaugaacaagcuguucgagcgcaccaagaagcagcuccgggagaacgcggaggacaugggcaacgggugcuucaagaucuaccacaagugcgacaacgccugcaucggcuccauccgcaacgggacguacgaccacgacguguaccgcgacgaggcccugaacaaccgguuccagaucaagggcguggagcugaaguccggcuacaaggacuggauccucuggaucuccuucgccaucagcugcuuccugcugugcgucgcccuccugggguucaucaugugggcgugccagaagggcaacauccgcugcaacaucugcaucuga

SEQ ID NO: 62812 - RNA, 1701 nt, Artificial Sequence
  derived and/or modified sequence opt1 from hemagglutinin__InfluenzaA__ABU92655
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugcccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacgccgagggcaccgggcaggccgcggaccugaaguccacccaggccgccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgcggaggacaugggcaacgggugcuucaagaucuaccacaagugcgacaacgccugcaucggcuccauccgcaacgggacguacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggcgugccagaagggcaacauccggugcaacaucugcaucuga

SEQ ID NO: 62813 - RNA, 1701 nt, Artificial Sequence; identical to SEQ ID NO: 62770
  derived and/or modified sequence opt1 from hemagglutinin__InfluenzaA__ABU92656

SEQ ID NO: 62814 - RNA, 1701 nt, Artificial Sequence; identical to SEQ ID NO: 61641
  derived and/or modified sequence opt1 from hemagglutinin__InfluenzaA__ABU92657

SEQ ID NO: 62815 - RNA, 1701 nt, Artificial Sequence; identical to SEQ ID NO: 62770
  derived and/or modified sequence opt1 from hemagglutinin__InfluenzaA__ABU92658

SEQ ID NO: 62816 - RNA, 1701 nt, Artificial Sequence; identical to SEQ ID NO: 61641
  derived and/or modified sequence opt1 from hemagglutinin__InfluenzaA__ABU92659

SEQ ID NO: 62817 - RNA, 1701 nt, Artificial Sequence; identical to SEQ ID NO: 62770
  derived and/or modified sequence opt1 from hemagglutinin__InfluenzaA__ABU92660

SEQ ID NO: 62818 - RNA, 1701 nt, Artificial Sequence
  derived and/or modified sequence opt1 from hemagglutinin__InfluenzaA__ABU92661
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucgacuggaccggggugacccagaacggcaccagcuccgccugcaagcgccggagcgacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccgggcggaucaccgugagcacgaagcgcagccagcagaccgugaucccgaacaucggcucccggccccgcguccgggacgugagcucccgcaucagcaucuacuggaccaucgugaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggaccggccaggccgccgaccugaaguccacccaggcggccaucaaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcuggagagcggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 62819 - RNA, 1701 nt, Artificial Sequence; identical to SEQ ID NO: 61081
  derived and/or modified sequence opt1 from hemagglutinin__InfluenzaA__ABU92662

SEQ ID NO: 62820 - RNA, 1701 nt, Artificial Sequence; identical to SEQ ID NO: 62770
  derived and/or modified sequence opt1 from hemagglutinin__InfluenzaA__ABU92663

SEQ ID NO: 62821 - RNA, 1701 nt, Artificial Sequence; identical to SEQ ID NO: 62770
  derived and/or modified sequence opt1 from hemagglutinin__InfluenzaA__ABU92664

SEQ ID NO: 62822 - RNA, 1701 nt, Artificial Sequence
  derived and/or modified sequence opt1 from hemagglutinin__InfluenzaA__ABU92665
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugcccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugacccagaacacccugaagcucgcgacggggaugcgcaacgugcccgagaagcagacccggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 62823 - RNA, 1701 nt, Artificial Sequence; identical to SEQ ID NO: 62770
  derived and/or modified sequence opt1 from hemagglutinin__InfluenzaA__ABU92666

SEQ ID NO: 62824 - RNA, 1701 nt, Artificial Sequence; identical to SEQ ID NO: 61080
  derived and/or modified sequence opt1 from hemagglutinin__InfluenzaA__ABU92667

SEQ ID NO: 62825 - RNA, 1701 nt, Artificial Sequence; identical to SEQ ID NO: 61080
  derived and/or modified sequence opt1 from hemagglutinin__InfluenzaA__ABU92668

SEQ ID NO: 62826 - RNA, 1701 nt, Artificial Sequence
  derived and/or modified sequence opt1 from hemagglutinin__InfluenzaA__ABU92669
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggagcacggccuacuccaacugcuaccccuacgacgucccggacuacgcgagccuccgcucccugguggccagcuccggcacccuggaguucaacaacgagagcuucaacuggaccggcguggcccagaacgggaccuccagcgccugcaagcggcgcuccaucaagagcuucuucucccggcucaacuggcugcaccagcugaaguacaaguaccccgcgcucaacgucacgaugcccaacaacgagaaguucgacaagcuguacaucuggggcgugcaccaccccagcaccgacuccgaccagaucagccuguacgcccaggccagcgggcgcgugaccgucuccaccaagcggagccagcagacggugaucccgaacaucggcucccgccccugggugcgcggggucagcucccggaucagcaucuacuggaccaucgugaagcccggcgacauccuccugaucaacuccaccggcaaccugaucgcgccccggggguacuucaagauccgcaacggcaagagcuccaucaugcggagcaacgccccgaucgggaagugcaacuccgagugcaucacccccaacggcagcauccccaacgacaagcccuuccagaacgugaaccgcaucacguacggcgccugcccgcgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacuccgagggcacggggcaggccgcggaccugaaguccacccaggccgccaucaaccagaucaacggcaagcucaaccggcugaucgagaagaccaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacacgaucgaccugaccgacuccgagaugaacaagcuguucgagcggacccgcaagcagcuccgcgagaacgcggaggacaugggcaacggcugcuucaagaucuaccacaagugcgacaacgccugcaucgggagcauccggaacggcaccuacgaccacgacgucuaccgcgacgaggcccugaacaaccgguuccagaucaaggggguggagcugaaguccggcuacaaggacuggauccucuggaucagcuucgccaucagcugcuuccugcugugcgucgugcuccugggguucaucaugugggccugccagaagggcaacauccgcugcaacaucugcaucuga

SEQ ID NO: 62827 - RNA, 1701 nt, Artificial Sequence; identical to SEQ ID NO: 61080
  derived and/or modified sequence opt1 from hemagglutinin__InfluenzaA__ABU92670

SEQ ID NO: 62828 - RNA, 1701 nt, Artificial Sequence
  derived and/or modified sequence opt1 from hemagglutinin__InfluenzaA__ABU92671
augaagaccaucaucgcccugagccacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacaucccccaccagauccuggacggggagaacugcacccugaucgacgcccuccugggcgacccccacugcgacggguuccagaacaaggagugggaccuguucguggagcgguccacggccuacagcaacugcuaccccuacgacgucccggacuacgcgucccuccgcagccugguggccuccagcggcacccuggaguucaacaacgaguccuucaacuggaccggcguggcccagaacgggaccagcuccgccugcaagcggcgcagcaucaaguccuucuucagccggcucaacuggcugcaccagcugaaguacaaguaccccgcgcucaacgucacgaugcccaacaacgagaaguucgacaagcuguacaucuggggcgugcaccaccccuccaccgacagcgaccagaucucccuguacgcccaggccccggggcgcgugaccgucagcaccaagcggagccagcagacggugauccccaacaucggcucccgccccugggugcgcggggucagcucccggaucagcaucuacuggaccaucgugaagcccggcgacauccuccugaucaacuccaccggcaaccugaucgccccgcggggguacuucaagauccgcagcggcaaguccagcaucaugcgguccaacgcccccaucgggaagugcaacagcgagugcaucacccccaacggcuccauccccaacgacaagccguuccagaacgugaaccgcaucacguacggcgcgugcccccgguacgucaagcagaacacccucaagcuggccaccgggaugcgcaacgugcccgagaagcagacccggggcaucuucggggccaucgccggcuucaucgagaacgggugggagggcaugguggacggcugguacggguuccgccaccagaacagcgagggcacggggcaggccgcggaccugaaguccacccaggccgccaucaaccagaucaacggcaagcucaaccggcugaucgagaagaccaacgagaaguuccaccagaucgagaaggaguucagcgaggccgaggggcgcauccaggaccuggagaaguacgucgaggacaccaagaucgaccucugguccuacaacgccgagcugcugguggcgcucgagaaccagcacacgaucgaccugaccgacagcgagaugaacaagcuguucgagcggacccgcaagcagcuccgcgagaacgccgaggacaugggcaacggcugcuucaagaucuaccacaagugcgacaacgccugcaucggguccauccggaacggcaccuacgaccacgacguguaccgcgacgaggcccugaacaaccgguuccagaucaagggggucgagcucaagagcggcuacaaggacuggauccuguggaucuccuucgccaucagcugcuuccugcugugcgugguccuccugggguucaucaugugggcgugccagaagggcaacauccgcugcaacaucugcaucuga

SEQ ID NO: 62829 - RNA, 1701 nt, Artificial Sequence; identical to SEQ ID NO: 61080
  derived and/or modified sequence opt1 from hemagglutinin__InfluenzaA__ABU92672

SEQ ID NO: 62830 - RNA, 1701 nt, Artificial Sequence; identical to SEQ ID NO: 61080
  derived and/or modified sequence opt1 from hemagglutinin__InfluenzaA__ABU92673

SEQ ID NO: 62831 - RNA, 1701 nt, Artificial Sequence
  derived and/or modified sequence opt1 from hemagglutinin__InfluenzaA__ABU92674
augaagaccaucaucgcccugagcuacauccucugccugguguucgcccagaagcugcccgucaacgacaacuccaccgcgacgcucugccugggccaccacgccgugccgaacgggacccuggugaagaccaucaccaacgaccacaucgaggucacgaacgccaccgagcucgugcagagcuccagcaccggccgcaucugcgacagcccccaccagauccuggacggggagaacugcacccugaucgacgcccuccugggcgacccccacugcgacggguuccagaacaaggagugggaccuguucguggagcggcgcacggccuacagcaacugcuaccccuacgacgucccggacuacgcgucccuccggagccugguggccuccagcggcacccuggaguucaacaacgaguccuucaacuggaccggcguggcccagaacgggaccagcuccgccugcaagcgccggagcaucaaguccuucuucagccgccucaacuggcugcaccagcugaaguacaaguaccccgcgcucaacgucacgaugcccaacaacgagaaguucgacaagcuguacaucuggggcgugcaccaccccuccaccgacagcgaccagaucucccuguacgcccaggccagcgggcgggugaccgucagcaccaagcgcucccagcagacggugaucccgaacaucggcagccggcccugggugcgcggggucuccagccggaucuccaucuacuggaccaucgugaagcccggcgacauccuccugaucaacagcaccggcaaccugaucgcgccccgcggguacuucaagauccgguccggcaagagcuccaucaugcgcagcaacgccccgaucgggaagugcaacuccgagugcaucacccccaacggcagcauccccaacgacaagcccuuccagaacgugaaccggaucacguacggcgccugcccgcgcuacgucaagcagaacacccucaagcuggccaccgggaugcggaacgugcccgagaagcagacccgcggcaucuucggggccaucgccggcuucaucgagaacgggugggagggcaugguggacggcugguacggguuccggcaccagaacuccgagggcacggggcaggccgcggaccugaaguccacccaggccgccaucaaccagaucaacggcaagcucaaccgccugaucgagaagaccaacgagaaguuccaccagaucgagaaggaguucuccgaggucgaggggcggauccaggaccuggagaaguacguggaggacaccaagaucgaccucuggagcuacaacgccgagcugcugguggcccucgagaaccagcacacgaucgaccugaccgacuccgagaugaacaagcuguucgagcgcacccgcaagcagcuccgggagaacgcggaggacaugggcaacggcugcuucaagaucuaccacaagugcgacaacgccugcaucgggagcauccgcaacggcaccuacgaccacgacgucuaccgggacgaggcccugaacaaccgcuuccagaucaaggggguggagcugaaguccggcuacaaggacuggauccucuggaucagcuucgccaucagcugcuuccugcugugcgucgugcuccugggguucaucaugugggccugccagaagggcaacauccggugcaacaucugcaucuga

SEQ ID NO: 62832 - RNA, 1701 nt, Artificial Sequence
  derived and/or modified sequence opt1 from hemagglutinin__InfluenzaA__ABU92675
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccgacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaugggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62833 - RNA, 1701 nt, Artificial Sequence; identical to SEQ ID NO: 61641
  derived and/or modified sequence opt1 from hemagglutinin__InfluenzaA__ABU92676

SEQ ID NO: 62834 - RNA, 1701 nt, Artificial Sequence; identical to SEQ ID NO: 62761
  derived and/or modified sequence opt1 from hemagglutinin__InfluenzaA__ABU92677

SEQ ID NO: 62835 - RNA, 1701 nt, Artificial Sequence
  derived and/or modified sequence opt1 from hemagglutinin__InfluenzaA__ABU92678
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggccugcagaacaagaagugggaccuguucguggagcgcagcaaggccuacuccaacugcuaccccuacgacgugccggacuacgcgagccuccggucccugaucgccagcuccgggacgcuggaguucaacaacgagagcuucaacuggaccggcgucacccagaacgggaccuccagcgccugcaagcgccgguccaacaacagcuucuucucccgccucaacuggcugacgcaccugaaguucaaguaccccgcccucaacgugaccaugcccaacaacgaggaguucgacaagcuguacaucuggggcgugcaccaccccgggaccgacaacgaccagaucagccuguacgcgcaggccuccggccggaucaccgucagcacgaagcgcagccagcagaccgugaucccgaacaucggcucccggccccgcgugcgggacauccccagccgcaucuccaucuacuggaccaucgucaagcccggggacauccuccugaucaacagcaccggcaaccugaucgccccgcggggguacuucaagauccgcuccggcaagagcuccaucaugcggagcgacgcccccaucggcaacugcaacuccgagugcaucacgcccaacgggagcauccccaacgacaagccguuccagaacgugaaccgcaucaccuacggcgccugcccccgguacgugaagcagaacacccucaagcuggcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucgaccagaucaacggcaagcucaaccggcugaucggcaagaccaacgagaaguuccaccagaucgagaaggaguucuccgagguggaggggcgcauccaggaccuggagaaguacgucgaggacaccaagaucgaccucuggagcuacaacgccgagcugcugguggcccucgagaaccagcacacgaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggaccuacgaccacgacguguaccgggacgaggcccugaacaaccgcuuccagaucaagggcgucgagcugaaguccggcuacaaggacuggauccucuggaucagcuucgccaucuccugcuuccugcugugcguggcccuccugggguucaucaugugggccugccagaagggcaacauccggugcaacaucugcaucuga

SEQ ID NO: 62836 - RNA, 1701 nt, Artificial Sequence
  derived and/or modified sequence opt1 from hemagglutinin__InfluenzaA__ABU92680
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 62837 - RNA, 1701 nt, Artificial Sequence; identical to SEQ ID NO: 62765
  derived and/or modified sequence opt1 from hemagglutinin__InfluenzaA__ABU92681

SEQ ID NO: 62838 - RNA, 1701 nt, Artificial Sequence; identical to SEQ ID NO: 61081
  derived and/or modified sequence opt1 from hemagglutinin__InfluenzaA__ABU92682

SEQ ID NO: 62839 - RNA, 1701 nt, Artificial Sequence; identical to SEQ ID NO: 62770
  derived and/or modified sequence opt1 from hemagglutinin__InfluenzaA__ABU92683

SEQ ID NO: 62840 - RNA, 1701 nt, Artificial Sequence
  derived and/or modified sequence opt1 from hemagglutinin__InfluenzaA__ABU92684
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucaucgagcgcuccaaggccuacagcaacugcuaccccuacgacgugccggacuacgcgucccugcggagccucguggccuccagcgggacgcuggaguucaacaacgaguccuucgacuggaccggcgucacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcgugcaccaccccgggaccgacuccgaccagaucagccuguacgcgcaggccccgggccggaucaccgucuccacgaagcgcagccagcagaccgugauccccaacaucggcagccggccccgcgugcgggacgucuccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaccgggcaggccgccgaccucaagagcacccaggcggccaucaaccagaucaacggcaagcugaaccggcugaucggcaagaccaacgagaaguuccaccagaucgagaaggaguucuccgaggucgaggggcgcauccaggaccuggagaaguacguggaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 62841 - RNA, 1701 nt, Artificial Sequence
  derived and/or modified sequence opt1 from hemagglutinin__InfluenzaA__ABU92685
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugaaguccgacgccccgaucggcaagugcaacagcgagugcaucacgcccaacggguccauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacagcgagggcaccgggcaggccgccgaccugaaguccacccaggcggccaucaaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgccgagcuccuggucgcccuggagaaccagcacaccaucgaccucaccgacagcgagaugaacaagcuguucgagcgcaccaagaagcagcugcgggagaacgccgaggacaugggcaacgggugcuucaagaucuaccacaagugcgacaacgcgugcaucggcuccauccgcaacgggacguacgaccacgacguguaccgcgacgaggcccucaacaaccgguuccagaucaagggcguggagcucaagagcggcuacaaggacuggauccuguggaucuccuucgccaucagcugcuuccugcugugcgucgcccugcucggguucaucaugugggccugccagaagggcaacauccgcugcaacaucugcaucuga

SEQ ID NO: 62842 - RNA, 1701 nt, Artificial Sequence; identical to SEQ ID NO: 62770
  derived and/or modified sequence opt1 from hemagglutinin__InfluenzaA__ABU92686

SEQ ID NO: 62843 - RNA, 1701 nt, Artificial Sequence; identical to SEQ ID NO: 62770
  derived and/or modified sequence opt1 from hemagglutinin__InfluenzaA__ABU92687

SEQ ID NO: 62844 - RNA, 1701 nt, Artificial Sequence; identical to SEQ ID NO: 62803
  derived and/or modified sequence opt1 from hemagglutinin__InfluenzaA__ABU92688

SEQ ID NO: 62845 - RNA, 1701 nt, Artificial Sequence; identical to SEQ ID NO: 62770
  derived and/or modified sequence opt1 from hemagglutinin__InfluenzaA__ABU92689

SEQ ID NO: 62846 - RNA, 1701 nt, Artificial Sequence
  derived and/or modified sequence opt1 from hemagglutinin__InfluenzaA__ABU92691
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcgucaugcgguccgacgccccgaucggcaagugcaacagcgagugcaucacgcccaacggguccauccccaacgacaagcccuuccagaacgugaaccgcaucaccuacggcgccugcccgcgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacgucgaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaucggcaacgggugcuucaagaucuaccacaagugcgacaacgcgugcaucggcuccauccgcaacgggacguacgaccacaacguguaccgggacgaggcccucaacaaccgcuuccagaucaagggcgucgagcucaagagcggcuacaaggacuggauccuguggaucuccuucgccaucagcugcuuccugcugugcguggcccugcucggguucaucaugugggccugccagaagggcaacauccggugcaacaucugcaucuga

SEQ ID NO: 62847 - RNA, 1701 nt, Artificial Sequence; identical to SEQ ID NO: 61698
  derived and/or modified sequence opt1 from hemagglutinin__InfluenzaA__ABU92692

SEQ ID NO: 62848 - RNA, 1701 nt, Artificial Sequence
  derived and/or modified sequence opt1 from hemagglutinin__InfluenzaA__ABU92693
augaaggccaucaucgcccugagcuacauccucugccugguguucgcgcagaagcugcccggcaacgacaacuccaccgccacccucugccuggggcaccacgccgucccgaacggcacgaucgugaagaccaucaccaacgaccagaucgaggugaccaacgccacggagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggcguacagcaacugcuaccccuacgacgugccggacuacgccucccugcggagccucgucgccuccagcggcacccuggaguucaacaacgaguccuucgacuggacgggggugacccagaacggcaccagcuccgccugcaagcgccggagcgacaaguccuucuucagccgccugaacuggcucacccaccugaaguacaaguaccccgcgcugaacgugacgaugcccaacaacgagaaguucgacaagcucuacaucuggggcguccaccaccccgggaccgacuccgaccagaucagccuguacgcccaggccuccgggcggaucaccgugagcaccaagcgcagccagcagacggugaucccgaacaucggcucccggccccgcguccgggacgugagcucccgcaucagcaucuacuggaccaucgugaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacagcgaggggacgggccaggccgcggaccugaaguccacccaggccgccaucaaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagcggaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaaggggguggagcucaagagcggcuacaaggacuggauccuguggaucuccuucgccaucagcugcuuccugcugugcgucgcccugcucggcuucaucaugugggcgugccagaaggggaacauccggugcaacaucugcaucuga

SEQ ID NO: 62849 - RNA, 1701 nt, Artificial Sequence
  derived and/or modified sequence opt1 from hemagglutinin__InfluenzaA__ABU92694
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagguggaccuguggagcuacaacgccgagcuccuggucgcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 62850 - RNA, 1701 nt, Artificial Sequence; identical to SEQ ID NO: 62761
  derived and/or modified sequence opt1 from hemagglutinin__InfluenzaA__ABU92695

SEQ ID NO: 62851 - RNA, 1701 nt, Artificial Sequence
  derived and/or modified sequence opt1 from hemagglutinin__InfluenzaA__ABU92696
augaagaccaucaucgcccugggcuacauccucugccugguguucgcccagaagcugcccgggaacgacaacagcaccgcgacgcucugccugggccaccacgccgucccgaacgggaccaucgugaagaccaucaccaacgaccagaucgaggugacgaacgccaccgagcugguccaguccagcuccaccggcgggaucugcgacagcccccaccagauccucgacggcgagaacugcacccugaucgacgcccugcucggcgacccccagugcgacggguuccagaacaagaagugggaccuguucguggagcgcuccaaggccuacagcaacugcuaccccuacgacgugccggacuacgcgucccugcggagccucaucgccuccagcggcacgcuggaguucaacaacgaguccuucaacuggaccggggucacccagaacggcaccagcuccgccugcaagcgccggagcaacuccagcuucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucagccuguacgcgcaggccuccggccggaucaccgucagcacgaagcgcagccagcagaccgugaucccgaacaucgggucccggccccgcgugcgggacauccccagccgcaucuccaucuacuggaccaucgucaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggcuucaucgagaacgggugggagggcaugguggacgggugguacggcuuccgccaccagaacuccgaggggaucggccaggccgccgaccucaagagcacccaggcggccaucgaccagaucaacggcaagcugaaccggcugaucgggaagaccaacgagaaguuccaccagaucgagaaggaguucuccgagguggagggccgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaagggcgucgagcugaaguccggguacaaggacuggauccuguggaucagcuucgccaucuccugcuuccuccugugcguggcccugcucggcuucaucaugugggccugccagaaggggaacauccggugcaacaucugcaucuga

SEQ ID NO: 62852 - RNA, 1701 nt, Artificial Sequence; identical to SEQ ID NO: 61641
  derived and/or modified sequence opt1 from hemagglutinin__InfluenzaA__ABU92697

SEQ ID NO: 62853 - RNA, 1701 nt, Artificial Sequence; identical to SEQ ID NO: 61251
  derived and/or modified sequence opt1 from hemagglutinin__InfluenzaA__ABU92698

SEQ ID NO: 62854 - RNA, 1701 nt, Artificial Sequence
  derived and/or modified sequence opt1 from hemagglutinin__InfluenzaA__ABU92699
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacugggccggcgugacccagaacgggaccuccagcgccugcaagcgccgguccaacaacagcuucuucucccgccugaacuggcucacccaccugaaguucaaguaccccgcgcugaacgugacgaugcccaacaacgagaaguucgacaagcucuacaucuggggcguccaccaccccgggaccgacaacgaccagaucuuccuguacgcccaggccagcggccggaucaccguguccaccaagcgcagccagcagacggugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacccccaacggguccauccccaacgacaagccguuccagaacgugaaccgcaucacguacggcgcgugcccccgguacgucaagcagaacacccugaagcucgccaccgggaugcgcaacgugcccgagaagcagacccggggcaucuucggggccaucgccggcuucaucgagaacggcugggaggggaugguggacggcugguacggguuccgccaccagaacagcgagggcaucgggcaggccgcggaccugaaguccacgcaggccgccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgggagaacgcggaggacaugggcaacgggugcuucaagaucuaccacaagugcgacaacgccugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggcgugccagaagggcaacauccgcugcaacaucugcaucuga

SEQ ID NO: 62855 - RNA, 1701 nt, Artificial Sequence
  derived and/or modified sequence opt1 from hemagglutinin__InfluenzaA__ABU92700
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgggaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagcgguucgacaagcucuacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 62856 - RNA, 1701 nt, Artificial Sequence
  derived and/or modified sequence opt1 from hemagglutinin__InfluenzaA__ABU92701
augaagaccaucaucgcccugagcuacauccucugccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgggaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagcgguucgacaagcucuacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgccugcagaucaaggggguggagcugaaguccggcuacaaggacuggauccucuggaucuccuucgccaucagcugcuuccugcugugcguggcccuccugggcuucaucaugugggccugccagaaggggaacauccggugcaacaucugcaucuga

SEQ ID NO: 62857 - RNA, 1701 nt, Artificial Sequence; identical to SEQ ID NO: 61620
  derived and/or modified sequence opt1 from hemagglutinin__InfluenzaA__ABU92702

SEQ ID NO: 62858 - RNA, 1701 nt, Artificial Sequence; identical to SEQ ID NO: 62836
  derived and/or modified sequence opt1 from hemagglutinin__InfluenzaA__ABU92703

SEQ ID NO: 62859 - RNA, 1701 nt, Artificial Sequence
  derived and/or modified sequence opt1 from hemagglutinin__InfluenzaA__ABU92704
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcaacaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccuccggccggaucaccgugagcacgaagcgcucccagcagaccgugaucccgaacaucggcagccggccccgcguccggaacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucgaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacaugggcaacgggugcuucaagaucuaccacaagugcgacaacgcgugcaucggcagcauccgcaacgggaccuacgaccacgacgucuaccgcgacgaggcccucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 62860 - RNA, 1701 nt, Artificial Sequence
  derived and/or modified sequence opt1 from hemagglutinin__InfluenzaA__ABU92705
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucagccuguacgcgcaggccccgggccggaucaccgucuccacgaagcgcagccagcagaccgugauccccaacaucggcagccggccccgcgugcgggacauccccucccgcaucagcaucuacuggaccaucgucaagccgggggacauccugcucaucaacuccaccggcaaccugaucgcgccccggggguacuucaagauccgcagcggcaaguccagcaucaugcgguccgacgcccccaucggcaagugcaagagcgagugcaucacgcccaacggguccaucccgaacgacaagcccuuccagaacgugaaccgcaucaccuacggcgccugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccggaucaagagcgucgagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 62861 - RNA, 1701 nt, Artificial Sequence; identical to SEQ ID NO: 61081
  derived and/or modified sequence opt1 from hemagglutinin__InfluenzaA__ABU92706

SEQ ID NO: 62862 - RNA, 1701 nt, Artificial Sequence; identical to SEQ ID NO: 62770
  derived and/or modified sequence opt1 from hemagglutinin__InfluenzaA__ABU92707

SEQ ID NO: 62863 - RNA, 1701 nt, Artificial Sequence; identical to SEQ ID NO: 62770
  derived and/or modified sequence opt1 from hemagglutinin__InfluenzaA__ABU92708

SEQ ID NO: 62864 - RNA, 1701 nt, Artificial Sequence
  derived and/or modified sequence opt1 from hemagglutinin__InfluenzaA__ABU92709
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacugggccggcgugacccagaacgggaccuccagcgccugcaagcgccgguccaacaagagcuucuucucccgccugaacuggcucacccaccugaaguacaaguaccccgcgcugaacgugacgaugcccaacaacgagaaguucgacaagcucuacaucuggggcguccaccaccccgggaccgacagcgaccagaucucccuguacgcccaggccagcggccggaucaccgugagcaccaagcgcucccagcagacggugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacccccaacgggagcauccccaacgacaagcccuuccagaacgucaaccgcaucacguacggcgccugcccgcgguacgugaagcagaacacccugaagcucgccaccgggaugcgcaacgugcccgagaagcagacccggggcaucuucggggccaucgccggcuucaucgagaacggcugggaggggauggucgacggcugguacggguuccgccaccagaacuccgagggcacggggcaggccgcggaccugaaguccacccaggccgccaucaaccagaucaacggcaagcugaaccggcucaucggcaagaccaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgcggaggacaugggcaacgggugcuucaagaucuaccacaagugcgacaacgccugcaucgagagcauccgcaacggcaccuacgaccacgacguguaccgggacgaggcccucaacaaccgcuuccagaucaaggggguggagcugaaguccggcuacaaggacuggauccuguggaucagcuucgccaucagcugcuuccuccugugcgucgcccugcucggcuucaucaugugggcgugccagaaggggaacauccggugcaacaucugcaucuga

SEQ ID NO: 62865 - RNA, 1701 nt, Artificial Sequence; identical to SEQ ID NO: 61059
  derived and/or modified sequence opt1 from hemagglutinin__InfluenzaA__ABU92710

SEQ ID NO: 62866 - RNA, 1701 nt, Artificial Sequence; identical to SEQ ID NO: 61081
  derived and/or modified sequence opt1 from hemagglutinin__InfluenzaA__ABU92711

SEQ ID NO: 62867 - RNA, 1701 nt, Artificial Sequence; identical to SEQ ID NO: 61081
  derived and/or modified sequence opt1 from hemagglutinin__InfluenzaA__ABU92712

SEQ ID NO: 62868 - RNA, 1701 nt, Artificial Sequence; identical to SEQ ID NO: 62770
  derived and/or modified sequence opt1 from hemagglutinin__InfluenzaA__ABU92713

SEQ ID NO: 62869 - RNA, 1701 nt, Artificial Sequence; identical to SEQ ID NO: 62770
  derived and/or modified sequence opt1 from hemagglutinin__InfluenzaA__ABU92714

SEQ ID NO: 62870 - RNA, 1701 nt, Artificial Sequence
  derived and/or modified sequence opt1 from hemagglutinin__InfluenzaA__ABU92715
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucgacuggaccggggugacccagaacggcaccagcuccgccugcaagcgccggagcaacaaguccuucuucagccgccugaacuggcucacgcaccugaaguacaaguaccccgcccugaacgugaccaugcccaacaacgagaaguucgagaagcucuacaucuggggcguccaccaccccgggaccgacuccgaccagaucaaccuguacgcgcaggccagcgggcggaucaccguguccacgaagcgcagccagcagaccgugaucccgaacaucggcagccggccccgcguccgggacguguccagccgcaucuccaucuacuggaccaucgugaagcccggcgacauccugcucaucaacagcaccgggaaccugaucgcgccccggggcuacuucaagauccgcuccggcaagagcuccaucaugcggagcgacgccccgaucgggaagugcaacuccgagugcaucacgcccaacggcagcauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgcgugcaucgggagcauccgcaacggcacguacgaccacgacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 62871 - RNA, 1701 nt, Artificial Sequence; identical to SEQ ID NO: 62770
  derived and/or modified sequence opt1 from hemagglutinin__InfluenzaA__ABU92716

SEQ ID NO: 62872 - RNA, 1701 nt, Artificial Sequence; identical to SEQ ID NO: 62770
  derived and/or modified sequence opt1 from hemagglutinin__InfluenzaA__ABU92717

SEQ ID NO: 62873 - RNA, 1701 nt, Artificial Sequence; identical to SEQ ID NO: 61081
  derived and/or modified sequence opt1 from hemagglutinin__InfluenzaA__ABU92718

SEQ ID NO: 62874 - RNA, 1701 nt, Artificial Sequence; identical to SEQ ID NO: 61081
  derived and/or modified sequence opt1 from hemagglutinin__InfluenzaA__ABU92719

SEQ ID NO: 62875 - RNA, 1701 nt, Artificial Sequence
  derived and/or modified sequence opt1 from hemagglutinin__InfluenzaA__ABU92720
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacuccagccugcggucccucgucgcgagcuccggcacgcuggaguucaacaacgagagcuucgacuggaccggggugacccagaacggcaccuccagcgccugcaagcgccgguccgacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcccaggcgagcgggcggaucaccgugagcacgaagcgcucccagcagaccgugaucccgaacaucggcagccggccccgcguccgggacguguccagccgcaucuccaucuacuggaccaucgugaagcccggcgacauccugcucaucaacagcaccgggaaccugaucgcgccccggggcuacuucaagauccgcuccggcaagagcuccaucaugcggagcgacgccccgaucgggaagugcaacuccgagugcaucacgcccaacggcagcauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagagcacccaggccgcgaucaaccagaucaacgggaagcugaaccggcugaucggcaagaccaacgagaaguuccaccagaucgagaaggaguucuccgagguggagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacauggggaacggcugcuucaagaucuaccacaagugcgacaacgccugcaucgggagcauccgcaacggcacguacgaccacgacguguaccgggacgaggcgcucaacaaccgcuuccagaucaaggggguggagcugaaguccggcuacaaggacuggauccuguggaucagcuucgccaucagcugcuuccuccugugcgucgcccugcucggcuucaucaugugggccugccagaaggggaacauccggugcaacaucugcaucuga

SEQ ID NO: 62876 - RNA, 1701 nt, Artificial Sequence
  derived and/or modified sequence opt1 from hemagglutinin__InfluenzaA__ABU92721
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucgacuggaccggggugacccagaacggcaccagcuccgccugcaagcgccggagcgacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccgggcggaucaccgugagcacgaagcgcagccagcagaccgugaccccgaacaucggcucccggccccgcguccgggacgugagcucccgcaucagcaucuacuggaccaucgugaagcccggcgacauccugcucaucaacuccacggggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgucaaccgcaucaccuacggggccugcccgcgguacgugaagcagaacacccugaagcucgccacgggcaugcgcaacgugcccgagaagcagacccgggggaucuucggcgccaucgccggguucaucgagaacggcugggagggcauggucgacgggugguacggcuuccgccaccagaacagcgaggggaccggccaggccgccgaccugaaguccacccaggcggccaucaaccagaucaacgggaagcugaaccggcucaucggcaagacgaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacaccaucgaccucaccgacagcgagaugaacaagcuguucgagcggacgaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcucaagagcggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 62877 - RNA, 1701 nt, Artificial Sequence; identical to SEQ ID NO: 62761
  derived and/or modified sequence opt1 from hemagglutinin__InfluenzaA__ABU92722

SEQ ID NO: 62878 - RNA, 1701 nt, Artificial Sequence; identical to SEQ ID NO: 61081
  derived and/or modified sequence opt1 from hemagglutinin__InfluenzaA__ABU92723

SEQ ID NO: 62879 - RNA, 1701 nt, Artificial Sequence; identical to SEQ ID NO: 62864
  derived and/or modified sequence opt1 from hemagglutinin__InfluenzaA__ABU92724

SEQ ID NO: 62880 - RNA, 1701 nt, Artificial Sequence
  derived and/or modified sequence opt1 from hemagglutinin__InfluenzaA__ABU92725
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucaaccuguacgcgcaggccuccggccggaucaccgugagcacgaagcgcagccagcagaccgugaucccgaacaucggcucccggccccgcguccgggacgugcccagccgcaucuccaucuacuggaccaucgugaagcccggggaccugcuccugaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccucaagcuggcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcucaaccggcugaucggcaagaccaacgagaaguuccaccagaucgagaaggaguucuccgagguggaggggcgcauccaggaccuggagaaguacguggaggacacgaagaucgaccucuggagcuacaacgccgagcugcuggucgcccucgagaaccagcacaccaucgaccugaccgacuccgagaugaacaagcuguucgagcggaccaagaagcagcuccgcgagaacgccgaggacaugggcaacgggugcuucaagaucuaccacaagugcgacaacgcgugcaucggcagcauccgcaacgggacguacgaccacgacguguaccgggacgaggcccugaacaaccgcuuccagaucaagggcguggagcugaaguccggcuacaaggacuggauccucuggaucagcuucgccaucuccugcuuccugcugugcgucgcccuccugggguucaucaugugggccugccagaagggcaacauccggugcaacaucugcaucuga

SEQ ID NO: 62881 - RNA, 1701 nt, Artificial Sequence; identical to SEQ ID NO: 62864
  derived and/or modified sequence opt1 from hemagglutinin__InfluenzaA__ABU92726

SEQ ID NO: 62882 - RNA, 1701 nt, Artificial Sequence
  derived and/or modified sequence opt1 from hemagglutinin__InfluenzaA__ABU92727
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggacuucgacaagcucuacaucuggggcgugcaccaccccgggaccgacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62883 - RNA, 1701 nt, Artificial Sequence
  derived and/or modified sequence opt1 from hemagglutinin__InfluenzaA__ABU92728
augaagaccaucaucgcccugagcuacauccucugccagguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagaucagcuccaccggggagaucugcgacagcccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucgacuggaccggggugacccagaacggcaccagcuccgccugcaagcgccggagcgacaaguccuucuucagccgccugaacuggcugacgcaccucaaguacaaguaccccgcccugaacgugaccaugcccaacaacgagaaguucgacaagcuguacaucuggggcguccaccaccccgggaccgacaacgaccagaucucccucuacgcgcaggccagcgggcggaucaccguguccacgaagcgcagccagcagaccgugaucccgaacaucggcagccggccccgcguccgggacguguccagccgcaucuccaucuacuggaccaucgugaagcccggcgacauccugcugaucaacagcaccgggaaccucaucgcgccccggggcuacuucaagauccgcuccggcaagagcuccaucaugcggagcgacgccccgaucgggaagugcaacuccgagugcaucacgcccaacggcagcauccccaacgacaagcccuuccagaacgucaaccgcaucaccuacggggccugcccgcgguacgugaagcagaacacccugaagcuggccaccggcaugcgcaacgugcccgagaagcagacgcgggggaucuucggcgccaucgccggguucaucgagaacggcugggagggcauggucgacgggugguacggcuuccgccaccagaacuccgaggggaccggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccucgagaaguacguggaggacacgaagaucgaccuguggagcuacaacgccgagcugcucgucgcccuggagaaccagcacaccaucgaccugaccgacuccgagaugaacaagcuguucgagcggaccaagaagcagcuccgcgagaacgccgaggacauggggaacggcugcuucaagaucuaccacaagugcgacaacgcgugcaucgggagcauccgcaacggcacguacgaccacgacguguaccgggacgaggcccugaacaaccgcuuccagaucaaggggguggagcucaaguccggcuacaaggacuggauccuguggaucagcuucgccaucuccugcuuccugcucugcgucgcccugcugggcuucaucaugugggccugccagaaggggaacauccggugcaacaucugcaucuga

SEQ ID NO: 62884 - RNA, 1701 nt, Artificial Sequence; identical to SEQ ID NO: 62883
  derived and/or modified sequence opt1 from hemagglutinin__InfluenzaA__ABU92729

SEQ ID NO: 62885 - RNA, 1701 nt, Artificial Sequence; identical to SEQ ID NO: 62761
  derived and/or modified sequence opt1 from hemagglutinin__InfluenzaA__ABU92730

SEQ ID NO: 62886 - RNA, 1701 nt, Artificial Sequence
  derived and/or modified sequence opt1 from hemagglutinin__InfluenzaA__ABU92731
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacguguggggcguccaccaccccgggaccuacaacgaccagaucucccuguacgcgcaggccagcggccggaucaccgugagcacgaagcgcucccagcagaccgugaucccgaacaucggcagccggccccgcguccgggacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 62887 - RNA, 1701 nt, Artificial Sequence
  derived and/or modified sequence opt1 from hemagglutinin__InfluenzaA__ABU92732
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacagcuccuucuucagccgccugaacuggcucacgcaccugaaguucaaguaccccgcccugaacgugaccaugcccaacaacgaggaguucgacaagcucuacaucuggggcgugcaccaccccgggaccuacaacgaccagaucucccuguacgcgcaggccagcggccggaucaccgucagcacgaagcgcucccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggugcugcucggguucaucaugugggccugccagaagggcaacauccggugcaacaucugcaucuga

SEQ ID NO: 62888 - RNA, 1701 nt, Artificial Sequence
  derived and/or modified sequence opt1 from hemagglutinin__InfluenzaA__ABU92733
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucaucgagcgcagcaaggccuacuccaacugcuaccccuacgacgugccggacuacgcgagccugcggucccucguggccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucagccuguacgcgcaggccuccggccggaucaccgucagcacgaagcgcagccagcagaccgugaucccgaacaucggcucccggccccgcgugcgggacauccccagccgcaucuccaucuacuggaccaucgucaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacaccaagguggaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacaaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 62889 - RNA, 1701 nt, Artificial Sequence; identical to SEQ ID NO: 62761
  derived and/or modified sequence opt1 from hemagglutinin__InfluenzaA__ABU92734

SEQ ID NO: 62890 - RNA, 1701 nt, Artificial Sequence
  derived and/or modified sequence opt1 from hemagglutinin__InfluenzaA__ABU92735
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgggagcccccaccagauccucgacggcgagaacugcacccugaucgacgcccugcucggcgacccccagugcgacggguuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccccggcccggaucaccguguccacgaagcgcagccagcagaccgugauccccaacaucggcagccggccccgcguccgggacauccccucccgcaucagcaucuacuggaccaucgugaagccgggggacauccugcucaucaacuccaccggcaaccugaucgcgccccggggguacuucaagauccugagcggcaaguccagcaucaugcgcuccgacgcccccaucggcaagugcaacagcgagugcaucacgcccaacggguccaucccgaacgacaagcccuuccagaacgugaaccggaucaccuacggcgccugcccccgcuacgucaagcagaacacccucaagcuggccaccgggaugcggaacgugcccgagaagcagacgcgcggcaucuucggggccaucgccggcuucaucgagaacggcugggaggggaugguggacggcugguacggguuccggcaccagaacagcgagggcaucgggcaggccgcggaccugaaguccacccaggccgccaucaaccagaucaacggcaagcucaaccgccugaucggcaagaccaacgagaaguuccaccagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagcgcaccaagaagcagcuccgggagaacgcggaggacaugggcaacgggugcuucaagaucuaccacaagugcgacaacgccugcaucggcuccauccgcaacgggaccuacgaccacgacgucuaccgcgacgaggcccugaacaaccgguuccagaucaagggcguggagcugaaguccggcuacaaggacuggauccucuggaucuccuucgccaugagcugcuuccugcugugcguggcccuccugggguucaucaugugggcgugccagaagggcaacauccgcugcaacaucugcaucuga

SEQ ID NO: 62891 - RNA, 1701 nt, Artificial Sequence; identical to SEQ ID NO: 62836
  derived and/or modified sequence opt1 from hemagglutinin__InfluenzaA__ABU92737

SEQ ID NO: 62892 - RNA, 1701 nt, Artificial Sequence
  derived and/or modified sequence opt1 from hemagglutinin__InfluenzaA__ABU92738
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucagccuguacgcgcaggccccgggccggaucaccgucuccacgaagcgcagccagcagaccgugauccccaacaucggcagccggccccgcgugcgggacauccccucccgcaucagcaucuacuggaccaucgucaagccgggggacauccugcucaucaacuccaccggcaaccugaucgcgccccggggguacuucaagauccgcagcggcaaguccagcaucaugcgguccgacgcccccaucggcaagugcaacagcgagugcaucacgcccaacggguccaucccgaacgacaagcccuuccagaacgugaaccgcaucaccuacggcgccugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggugcugcucggguucaucaugugggccugccagaagggcaacauccggugcaacaucugcaucuga

SEQ ID NO: 62893 - RNA, 1701 nt, Artificial Sequence; identical to SEQ ID NO: 62770
  derived and/or modified sequence opt1 from hemagglutinin__InfluenzaA__ABU92739

SEQ ID NO: 62894 - RNA, 1701 nt, Artificial Sequence
  derived and/or modified sequence opt1 from hemagglutinin__InfluenzaA__ABU92740
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacacgcugcucggggacccccagugcgacggcuuccagaacaagaagugggaccuguucguggagcgcagcaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcaagcgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcccaggcgagcgggcggaucacgguguccaccaagcgcagccagcagaccgugaucccgaacaucggcagccggccccgcguccggaacauccccucccgcaucagcaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacagcgaggggaucggccaggccgccgaccugaaguccacccaggccgcgaucaaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgccugcaucggguccauccgcaacggcacguacgaccacgacgucuaccgggacgaggcgcucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 62895 - RNA, 1701 nt, Artificial Sequence
  derived and/or modified sequence opt1 from hemagglutinin__InfluenzaA__ABU92741
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucagccuguacgcgcaggccccgggccggaucaccgucuccacgaagcgcagccagcagaccgugauccccaacaucggcagccggccccgcgugcgggacauccccucccgcaucagcaucuacuggaccaucgucaagccgggggacauccugcucaucaacuccaccggcaaccugaucgcgccccggggguacuucaagauccgcagcggcaaguccagcaucaugcgguccgacgcccccaucggcaagugcaacagcgagugcaucacgcccaacggguccaucccgaacgacaagcccuuccagaacgugaaccgcaucaccuacggcgccugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacaucuaccgggacgaggcccucaacaaccgcuuccagaucaagggcguggagcugaaguccggcuacaaggacuggauccuguggaucuccuucgccaucagcugcuuccuccugugcgucgugcugcucggguucaucaugugggccugccagaagggcaacauccggugcaacaucugcaucuga

SEQ ID NO: 62896 - RNA, 1701 nt, Artificial Sequence; identical to SEQ ID NO: 62836
  derived and/or modified sequence opt1 from hemagglutinin__InfluenzaA__ABU92742

SEQ ID NO: 62897 - RNA, 1701 nt, Artificial Sequence
  derived and/or modified sequence opt1 from hemagglutinin__InfluenzaA__ABU92743
augaagaccaucaucgcccugagcuacauccucuaccugguguucgcccagaagcugcccgagaacgacaacuccaccgcgacgcucugccugggccaccacgccgucccgaacgggaccaucgugaagaccaucaccaacgaccagaucgaggugacgaacgccaccgagcugguccagagcuccagcaccggcgggaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 62898 - RNA, 1701 nt, Artificial Sequence; identical to SEQ ID NO: 62836
  derived and/or modified sequence opt1 from hemagglutinin__InfluenzaA__ABU92744

SEQ ID NO: 62899 - RNA, 1701 nt, Artificial Sequence
  derived and/or modified sequence opt1 from hemagglutinin__InfluenzaA__ABU92745
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucagccuguacgcgcaggccccgggccggaucaccgucuccacgaagcgcagccagcagaccgugauccccaacaucggcagccggccccgcgugcgggacauccccucccgcaucagcaucuacuggaccaucgucaagccgggggacauccugcucaucaacuccaccggcaaccugaucgcgccccggggguacuucaagauccgcaucggcaagagcuccaucaugcggagcgacgcccccaucggcaagugcaacuccgagugcaucacgcccaacgggagcaucccgaacgacaagcccuuccagaacgugaaccgcaucaccuacggcgccugcccccgguacgugaagcagaacacccugaagcucgccaccgggaugcgcaacguccccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucgaccagaucaacggcaagcugaaccggcucaucggcaagaccaacgagaaguuccaccagaucgagaaggaguucuccgagguggaggggcgcauccaggaccuggagaaguacgucgaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacguguaccgggacgaggcccucaacaaccgcuuccagaucaagggcgucgagcugaaguccggcuacaaggacuggauccuguggaucagcuucgccaucuccugcuuccuccugugcguggugcugcucggguucaucaugugggccugccagaagggcaacauccggugcaacaucugcaucuga

SEQ ID NO: 62900 - RNA, 1701 nt, Artificial Sequence; identical to SEQ ID NO: 62836
  derived and/or modified sequence opt1 from hemagglutinin__InfluenzaA__ABU92746

SEQ ID NO: 62901 - RNA, 1701 nt, Artificial Sequence; identical to SEQ ID NO: 61081
  derived and/or modified sequence opt1 from hemagglutinin__InfluenzaA__ABU92747

SEQ ID NO: 62902 - RNA, 1701 nt, Artificial Sequence
  derived and/or modified sequence opt1 from hemagglutinin__InfluenzaA__ABU92748
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcacagcaaguucaaguaccccgcccugaacgugaccaugcccaacaacgagaaguucgacaagcuguacaucuggggcguccaccaccccgggaccgacaacgaccagaccuuccucuacgcgcaggccuccgggcggaucacggugagcaccaagcgcagccagcagaccgugaucccgaacaucggcucccggccccgcguccggaacauccccagccgcaucuccaucuacuggaccaucgugaagcccggcgacauccugcugaucaacagcacggggaaccucaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucaccuacggggccugcccccgguacgucaagcagaacacccugaagcuggcgacgggcaugcgcaacgugcccgagaagcagacccgggggaucuucggcgccaucgccggguucaucgagaacggcugggagggcaugguggacgggugguacggcuuccgccaccagaacuccgaggggaucggccaggccgccgaccucaagagcacccaggcggccaucaaccagaucaacgggaagcugaaccggcugaucggcaagaccaacgagaaguuccaccagaucgagaaggaguucuccgaggucgagggccgcauccaggaccucgagaaguacguggaggacacgaagaucgaccuguggagcuacaacgccgagcugcucguggcccuggagaaccagcacaccaucgaccugaccgacuccgagaugaacaagcuguucgagcggaccaagaagcagcuccgcgagaacgccgaggacauggggaacggcugcuucaagaucuaccacaagugcgacaacgcgugcaucgggagcauccgcaacggcacguacgaccacgacgucuaccgggacgaggcccugaacaaccgcuuccagaucaaggggguggagcucaaguccggcuacaaggacuggauccuguggaucagcuucgccaucuccugcuuccugcucugcgugguccugcugggcuucaucaugugggccugccagaaggggaacauccggugcaacaucugcaucuga

SEQ ID NO: 62903 - RNA, 1701 nt, Artificial Sequence; identical to SEQ ID NO: 61081
  derived and/or modified sequence opt1 from hemagglutinin__InfluenzaA__ABU92749

SEQ ID NO: 62904 - RNA, 1701 nt, Artificial Sequence
  derived and/or modified sequence opt1 from hemagglutinin__InfluenzaA__ABU92750
augaagaccaucaucgcccugagcuacauccucugccugguguucgcccagaagcugcccggcaacgacaaccgcaccgcgacgcucugccuggggcaccacgccgucccgaacggcaccaucgugaagaccaucaccaacgaccagaucgaggugacgaacgccaccgagcugguccagaucuccagcaccgggggcaucugcgacagcccccaccagauccucgacggggagaacugcacccugaucgacgcccugcucggcgacccccagugcgacggcuuccagaacaagaagugggaccuguucguggagcggagcaaggccuacuccaacugcuaccccuacgacgugccggacuacgcgagccugcgcucccucgucgccagcuccgggacgcuggaguucaacaacgagagcuucgacuggaccggcgugacccagaacgggaccuccagcgccugcaagcggcgcuccaacaagagcuucuucucccggcugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccgcaucaccguguccacgaagcggagccagcagaccgugaucccgaacaucggcagccgcccccggguccgcgacguguccagccggaucuccaucuacuggaccaucgugaagcccggggacauccugcucaucaacagcaccggcaaccugaucgcgccccgcggguacuucaagauccgguccggcaagagcuccaucaugcgcagcgacgccccgaucggcaagugcaacuccgagugcaucacgcccaacgggagcauccccaacgacaagcccuuccagaacgucaaccggaucaccuacggcgccugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 62905 - RNA, 1701 nt, Artificial Sequence
  derived and/or modified sequence opt1 from hemagglutinin__InfluenzaA__ABU92751
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcaacaucugcaucuga

SEQ ID NO: 62906 - RNA, 1701 nt, Artificial Sequence; identical to SEQ ID NO: 62770
  derived and/or modified sequence opt1 from hemagglutinin__InfluenzaA__ABU92752

SEQ ID NO: 62907 - RNA, 1701 nt, Artificial Sequence; identical to SEQ ID NO: 61081
  derived and/or modified sequence opt1 from hemagglutinin__InfluenzaA__ABU92753

SEQ ID NO: 62908 - RNA, 1701 nt, Artificial Sequence; identical to SEQ ID NO: 62770
  derived and/or modified sequence opt1 from hemagglutinin__InfluenzaA__ABU92754

SEQ ID NO: 62909 - RNA, 1701 nt, Artificial Sequence
  derived and/or modified sequence opt1 from hemagglutinin__InfluenzaA__ABU92755
augaagaccaucaucgcccugagcuacauccucugccugguguucgcccagaagcugcccggcaacgacaacgggaccgcgacgcucugccugggccaccacgccgucccgaacgggaccaucgugaagaccaucaccaacgaccagaucgaggugacgaacgccaccgagcugguccaguccagcuccaccggcgggaucugcgacagcccccaccagauccucgacggcgagaacugcacccugaucgacgcccugcucggcgacccccagugcgacggguuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcaagcgccggagcaacaaguccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucucccuguacgcgcaggccagcggccggaucaccguguccacgaagcgcagccagcagaccgugaucccgaacaucgggagccggccccgcguccgggacgugcccucccgcaucagcaucuacuggaccaucgugaagcccggcgacauccugcucaucaacuccaccgggaaccugaucgccccgcggggcuacuucaagauccgcagcggcaaguccagcaucaugcgguccgacgcccccaucgggaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggcuucaucgagaacgggugggagggcauggucgacgggugguacggcuuccgccaccagaacgccgaggggaccggccaggccgcggaccucaagagcacccaggccgccaucaaccagaucaacggcaagcugaaccggcugaucgggaagaccaacgagaaguuccaccagaucgagaaggaguucuccgagguggagggccgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgcggaggacauggggaacggcugcuucaagaucuaccacaagugcgacaacgccugcaucgggagcauccgcaacggcacguacgaccacaacguguaccgggacgaggcccucaacaaccgcuuccagaucaagggcguggagcugaaguccggguacaaggacuggauccuguggaucagcuucgccaucuccugcuuccuccugugcgucgugcugcucggcuucaucaugugggccugccagaaggggaacauccggugcaacaucugcaucuga

SEQ ID NO: 62910 - RNA, 1701 nt, Artificial Sequence
  derived and/or modified sequence opt1 from hemagglutinin__InfluenzaA__ABU92756
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggcccacagcaacugcuaccccuacgacgugccggacuacgcgucccugcggagccucgucgccuccagcgggacgcuggaguucaacaacgaguccuucgacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgcccugcucggguucaucaugugggccugccagaagggcaacauccggugcaacaucugcaucuga

SEQ ID NO: 62911 - RNA, 1701 nt, Artificial Sequence
  derived and/or modified sequence opt1 from hemagglutinin__InfluenzaA__ABU92757
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcgacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucgacuggaccggggugacccagaacggcaccagcuccgccugcaagcgccggagcgacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccgggcggaucaccgugagcacgaagcgcagccagcagaccgugaucccgaacaucggcucccggccccgcguccgggacgugagcucccgcaucagcaucuacuggaccaucgugaagcccggcgacauccugcucaucaacuccaccgggaaccugaucgcgccccggggcuacuucaagauccgccggggcaagagcuccaucaugcgcagcgacgccccgaucgggaagugcaacuccgagugcaucacgcccaacggcagcauccccaacgacaagcccuuccagaacgucaaccggaucaccuacggggccugcccgcgcuacgugaagcagaacacccugaagcucgccaccggcaugcggaacgugcccgagaagcagacgcgcgggaucuucggcgccaucgccggguucaucgagaacggcugggagggcauggucgacgggugguacggcuuccggcaccagaacuccgaggggaccggccaggccgccgaccucaagagcacccaggcggccaucaaccagaucaacgggaagcugaaccgccugaucggcaagaccaacgagaaguuccaccagaucgagaaggaguucuccgagguggagggccggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgcgagaacgccgaggacauggggaacggcugcuucaagaucuaccacaagugcgacaacgcgugcaucgggagcauccggaacggcacguacgaccacgacguguaccgcgacgaggcccucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 62912 - RNA, 1701 nt, Artificial Sequence; identical to SEQ ID NO: 62770
  derived and/or modified sequence opt1 from hemagglutinin__InfluenzaA__ABU92758

SEQ ID NO: 62913 - RNA, 1701 nt, Artificial Sequence; identical to SEQ ID NO: 62770
  derived and/or modified sequence opt1 from hemagglutinin__InfluenzaA__ABU92759

SEQ ID NO: 62914 - RNA, 1701 nt, Artificial Sequence
  derived and/or modified sequence opt1 from hemagglutinin__InfluenzaA__ABU92760
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccggggagaucugcaacagcccccaccagauccucgacggcgagaacugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucgacuggaccggggugacccagaacggcaccagcuccgccugcaagcgccggagcgacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccgggcggaucaccgugagcacgaagcgcagccagcagaccgugaucccgaacaucggcucccggccccgcguccgggacgugagcucccgcaucagcaucuacuggaccaucgugaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacgcccaacggcuccauccccaacgacaagcccuuccagaacgucaaccgcaucaccuacggggccugcccgcgguacgugaagcagaacacccugaagcucgccaccggcaugcgcaacgugcccgagaagcagacgcgggggaucuucggcgccaucgccggguucaucgagaacggcugggagggcauggucgacgggugguacggcuuccgccaccagaacagcgaggggaccggccaggccgccgaccugaaguccacccaggcggccaucaaccagaucaacgggaagcugaaccggcucaucggcaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcacguacgaccacgacguguaccgggacgaggcccucaacaaccgcuuccagaucaaggggguggagcucaagagcggcuacaaggacuggauccuguggaucuccuucgccaucagcugcuuccugcugugcgucgcccugcucggcuucaucaugugggccugccagaaggggaacauccggugcaacaucugcaucuga

SEQ ID NO: 62915 - RNA, 1698 nt, Artificial Sequence
  derived and/or modified sequence opt1 from hemagglutinin__InfluenzaA__ABV29579
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagaagcggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 62916 - RNA, 1698 nt, Artificial Sequence
  derived and/or modified sequence opt1 from hemagglutinin__InfluenzaA__ABV29612
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagguggccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 62917 - RNA, 1698 nt, Artificial Sequence
  derived and/or modified sequence opt1 from hemagglutinin__InfluenzaA__ABV29634
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggaggcccccucccccgagaacgggaccugcuaccccggcuacuucgccgacuacgaggagcugcgcgagcagcucagcuccgugagcuccuucgagcgguucgagaucuucccgaaggagagcuccuggcccaaccacacggucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggcgaccagcgggcccuguaccacaccgagaacgccuacgugagcgucguguccagccacuacucccgccgguucacgcccgagaucgcgaagcgccccaaggugcgggaccaggagggccgcaucaacuacuacuggacccuccuggagcccggggacaccaucaucuucgaggccaacggcaaccugaucgccccgcgguucgccuucgcccucagccgcggguucggcuccggcaucaucaccagcaacgcgcccaugggggagugcgacgccaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgcgggcuucaucgagggcggguggaccgggaugguggacggcugguacggguaccaccaccagaacgagcagggcagcggcuacgccgccgaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggguuccuggacaucuggacguacaacgcggagcugcucgugcugcuggagaacgagcggacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcucaaccgcgagaagaucgacggcgugaagcuggagagcaugggggucuaccagauccuggccaucuacagcaccguggccuccagccucgugcugcuggucucccucggcgccaucagcuucuggaugugcuccaacgggagccugcagugccggaucugcaucuga

SEQ ID NO: 62918 - RNA, 1698 nt, Artificial Sequence
  derived and/or modified sequence opt1 from hemagglutinin__InfluenzaA__ABV29645
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagagcaagcucaaccgcgagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccggaucugcaucuga

SEQ ID NO: 62919 - RNA, 1698 nt, Artificial Sequence; identical to SEQ ID NO: 62918
  derived and/or modified sequence opt1 from hemagglutinin__InfluenzaA__ABV29667

SEQ ID NO: 62920 - RNA, 1698 nt, Artificial Sequence
  derived and/or modified sequence opt1 from hemagglutinin__InfluenzaA__ABV29678
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccguggacgagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 62921 - RNA, 1698 nt, Artificial Sequence
  derived and/or modified sequence opt1 from hemagglutinin__InfluenzaA__ABV29689
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagagccgcggccuguucggggccaucgccggcuucaucgagggcggguggaucggcaugguggacgggugguacggcuaccaccaccagaacgagcagggguccggcuacgccgcggaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggcgaucuacagcacgguggccagcucccucgugcugcuggucagccucggggccaucuccuucuggaugugcagcaacggcucccugcagugccggaucugcaucuga

SEQ ID NO: 62922 - RNA, 1698 nt, Artificial Sequence
  derived and/or modified sequence opt1 from hemagglutinin__InfluenzaA__ABV29700
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 62923 - RNA, 1701 nt, Artificial Sequence
  derived and/or modified sequence opt1 from hemagglutinin__InfluenzaA__ABV29711
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccagagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 62924 - RNA, 1701 nt, Artificial Sequence
  derived and/or modified sequence opt1 from hemagglutinin__InfluenzaA__ABV29722
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguuccuggaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcguggcccuccugggcuucaucaugugggccugccagaaggggaacauccgcugcaacaucugcaucuga

SEQ ID NO: 62925 - RNA, 1698 nt, Artificial Sequence
  derived and/or modified sequence opt1 from hemagglutinin__InfluenzaA__ABV29733
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacaagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcgacgacgagugcauggagagcgugaagaacgggacguacgacuaccccaaguacuccgaggagagcaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 62926 - RNA, 1698 nt, Artificial Sequence; identical to SEQ ID NO: 62918
  derived and/or modified sequence opt1 from hemagglutinin__InfluenzaA__ABV29744

SEQ ID NO: 62927 - RNA, 1698 nt, Artificial Sequence
  derived and/or modified sequence opt1 from hemagglutinin__InfluenzaA__ABV29755
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccucccccgagaacggcacgugcuaccccggcuacuucgccgacuacgaggagcugcgcgagcagcucagcuccgugagcuccuucgagcgguucgagaucuucccgaaggagagcuccuggcccaaccacaccgucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggggaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcagcggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcucaaccgcgagaagaucgacggcgugaagcuggagagcaugggggucuaccagauccuggccaucuacagcacgguggccuccagccucgugcugcuggucucccucggcgccaucagcuucuggaugugcuccaacgggagccugcagugccggaucugcaucuga

SEQ ID NO: 62928 - RNA, 1698 nt, Artificial Sequence; identical to SEQ ID NO: 62918
  derived and/or modified sequence opt1 from hemagglutinin__InfluenzaA__ABV29766

SEQ ID NO: 62929 - RNA, 1698 nt, Artificial Sequence
  derived and/or modified sequence opt1 from hemagglutinin__InfluenzaA__ABV29777
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacaagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 62930 - RNA, 1698 nt, Artificial Sequence; identical to SEQ ID NO: 62918
  derived and/or modified sequence opt1 from hemagglutinin__InfluenzaA__ABV29788

SEQ ID NO: 62931 - RNA, 1698 nt, Artificial Sequence; identical to SEQ ID NO: 62922
  derived and/or modified sequence opt1 from hemagglutinin__InfluenzaA__ABV29799

SEQ ID NO: 62932 - RNA, 1701 nt, Artificial Sequence
  derived and/or modified sequence opt1 from hemagglutinin__InfluenzaA__ABV29821
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagguguuccuguacgcgcaggccagcgggcggaucaccguguccacgaagcgcagccagcagaccgucaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacaucaagugcaacaucugcaucuga

SEQ ID NO: 62933 - RNA, 1698 nt, Artificial Sequence; identical to SEQ ID NO: 62922
  derived and/or modified sequence opt1 from hemagglutinin__InfluenzaA__ABV29832

SEQ ID NO: 62934 - RNA, 1698 nt, Artificial Sequence; identical to SEQ ID NO: 62918
  derived and/or modified sequence opt1 from hemagglutinin__InfluenzaA__ABV29865

SEQ ID NO: 62935 - RNA, 1698 nt, Artificial Sequence; identical to SEQ ID NO: 62918
  derived and/or modified sequence opt1 from hemagglutinin__InfluenzaA__ABV29876

SEQ ID NO: 62936 - RNA, 1701 nt, Artificial Sequence
  derived and/or modified sequence opt1 from hemagglutinin__InfluenzaA__ABV29898
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 62937 - RNA, 1701 nt, Artificial Sequence
  derived and/or modified sequence opt1 from hemagglutinin__InfluenzaA__ABV29909
augaagaccaucaucgcccugagcuacauccucugccugguguucgcccagaagcugcccggcaacgacaacuccaccgcgacgcucugccuggggcaccacgccgucccgaacggcaccaucgugaagaccaucaccagcgaccagaucgaggugacgaacgccaccgagcugguccagaacuccagcaucgggggcaucugcaacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacccuggaguucaacaacgagagcuucaacuggacgggcgucacccagaacgggaccuccagcgccugcaagcgccgguccaacaacagcuucuucucccgccugaacuggcucacccaccugaaguucaaguaccccgcccugaacgugacgaugcccaacaacgaggaguucgacaagcucuacaucuggggcgugcaccaccccgggaccgacaacgaccagaucagccuguacgcgcaggccccgggccggaucaccgucuccaccaagcgcagccagcagacggugauccccaacaucggcagccggccccgcgugcgggacauccccucccgcaucagcaucuacuggaccaucgucaagccgggggacauccugcucaucaacuccaccggcaaccugaucgcgccccggggguacuucaagauccgcagcggcaaguccagcaucaugcgguccgacgcccccaucgacaagugcaacagcgagugcaucacccccaacggcuccaucccgaacgacaagcccuuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggaucggccaggccgccgaccugaaguccacgcaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacaccaucgaccucacggacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 62938 - RNA, 1698 nt, Artificial Sequence
  derived and/or modified sequence opt1 from hemagglutinin__InfluenzaA__ABV29920
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccaugggggagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 62939 - RNA, 1698 nt, Artificial Sequence; identical to SEQ ID NO: 62929
  derived and/or modified sequence opt1 from hemagglutinin__InfluenzaA__ABV29942

SEQ ID NO: 62940 - RNA, 1698 nt, Artificial Sequence; identical to SEQ ID NO: 62922
  derived and/or modified sequence opt1 from hemagglutinin__InfluenzaA__ABV29953

SEQ ID NO: 62941 - RNA, 1698 nt, Artificial Sequence; identical to SEQ ID NO: 62922
  derived and/or modified sequence opt1 from hemagglutinin__InfluenzaA__ABV29964

SEQ ID NO: 62942 - RNA, 1698 nt, Artificial Sequence; identical to SEQ ID NO: 62918
  derived and/or modified sequence opt1 from hemagglutinin__InfluenzaA__ABV29986

SEQ ID NO: 62943 - RNA, 1698 nt, Artificial Sequence; identical to SEQ ID NO: 62922
  derived and/or modified sequence opt1 from hemagglutinin__InfluenzaA__ABV29997

SEQ ID NO: 62944 - RNA, 1698 nt, Artificial Sequence; identical to SEQ ID NO: 62918
  derived and/or modified sequence opt1 from hemagglutinin__InfluenzaA__ABV30008

SEQ ID NO: 62945 - RNA, 1698 nt, Artificial Sequence; identical to SEQ ID NO: 62922
  derived and/or modified sequence opt1 from hemagglutinin__InfluenzaA__ABV30019

SEQ ID NO: 62946 - RNA, 1698 nt, Artificial Sequence; identical to SEQ ID NO: 62922
  derived and/or modified sequence opt1 from hemagglutinin__InfluenzaA__ABV30030

SEQ ID NO: 62947 - RNA, 1698 nt, Artificial Sequence
  derived and/or modified sequence opt1 from hemagglutinin__InfluenzaA__ABV30041
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaccgcgccccuccagcuggggaacugcuccgucgccggcuggauccuggggaacccggagugcgagcuccugaucagcaaggaguccuggagcuacaucguggagacgcccaaccccgagaacgggaccugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucacggggaagaacggccuguaccccaaccugagcaaguccuacgccaacaacaaggagaaggaggugcucguccuguggggcgugcaccacccgcccaacaucggcgaccagcgggcccuguaccacaccgagaacgccuacgugagcgucgugagcucccacuacagccgccgguucacccccgagaucgccaagcgccccaaggugcgggaccaggagggccgcaucaacuacuacuggacccuccuggagcccggggacacgaucaucuucgaggcgaacggcaaccugaucgccccgcgguucgccuucgcccucucccgcggguucggcagcggcaucaucaccuccaacgcccccaugggggagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagaaccagcugaagaacaacgcgaaggagaucggcaacgggugcuucgaguucuaccacaagugcaacgacgagugcauggaguccgugaagaacggcacguacgacuaccccaaguacagcgaggaguccaagcucaaccgcgagaagaucgacggcgugaagcuggagagcaugggggucuaccagauccuggccaucuacuccaccguggccagcagccucgugcugcugaucucccucggcgccaucagcuucuggaugugcuccaacgggagccugcagugccggaucugcaucuga

SEQ ID NO: 62948 - RNA, 1701 nt, Artificial Sequence; identical to SEQ ID NO: 62936
  derived and/or modified sequence opt1 from hemagglutinin__InfluenzaA__ABV30063

SEQ ID NO: 62949 - RNA, 1701 nt, Artificial Sequence; identical to SEQ ID NO: 62936
  derived and/or modified sequence opt1 from hemagglutinin__InfluenzaA__ABV30074

SEQ ID NO: 62950 - RNA, 1698 nt, Artificial Sequence; identical to SEQ ID NO: 62922
  derived and/or modified sequence opt1 from hemagglutinin__InfluenzaA__ABV30085

SEQ ID NO: 62951 - RNA, 1698 nt, Artificial Sequence; identical to SEQ ID NO: 62922
  derived and/or modified sequence opt1 from hemagglutinin__InfluenzaA__ABV30096

SEQ ID NO: 62952 - RNA, 1698 nt, Artificial Sequence; identical to SEQ ID NO: 62918
  derived and/or modified sequence opt1 from hemagglutinin__InfluenzaA__ABV30107

SEQ ID NO: 62953 - RNA, 1698 nt, Artificial Sequence
  derived and/or modified sequence opt1 from hemagglutinin__InfluenzaA__ABV30129
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcaacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 62954 - RNA, 1698 nt, Artificial Sequence
  derived and/or modified sequence opt1 from hemagglutinin__InfluenzaA__ABV30140
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggaccgccacaacgggaagcucugccugcugaagggcaucgcgccccucaagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugagcuccuucgagcgcuucgagaucuucccgaaggagagcuccuggcccaaccacaccgucaccggggugagcgccuccugcagccacaacggcaaguccagcuucuaccggaaccugcuguggcucaccgggaagaacggccuguaccccaaccugucccgcagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcgucuaccagauccuggccaucuacuccacgguggccagcagccucgugcugcuggucucccucggggccaucagcuucuggaugugcuccaacggcagccugcagugccggaucugcaucuga

SEQ ID NO: 62955 - RNA, 1698 nt, Artificial Sequence
  derived and/or modified sequence opt1 from hemagglutinin__InfluenzaA__ABV30151
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacagcggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccaugggggagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcagcggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcucaaccgcgagaagaucgacggcgugaagcuggagagcaugggggucuaccagauccuggccaucuacagcacgguggccuccagccucgugcugcuggucucccucggcgccaucagcuucuggaugugcuccaacgggagccugcagugccggaucugcaucuga

SEQ ID NO: 62956 - RNA, 1698 nt, Artificial Sequence
  derived and/or modified sequence opt1 from hemagglutinin__InfluenzaA__ABV30162
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagacccccaaccccgagaacggcacgugcuaccccggcuacuucgccgacuacgaggagcugcgggagcagcucuccagcguguccagcuucgagcgcuucgagaucuucccgaaggaguccagcuggcccaaccacaccgucaccgggguguccgccagcugcucccacaacggcaagagcuccuucuaccggaaccugcuguggcucaccgggaagaacggccuguaccccaaccugagcaaguccuacgccaacaacaaggagaaggaggugcucguccuguggggcgugcaccacccgcccaacaucggggaccagcgcgcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcaccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 62957 - RNA, 1698 nt, Artificial Sequence; identical to SEQ ID NO: 62922
  derived and/or modified sequence opt1 from hemagglutinin__InfluenzaA__ABV30173

SEQ ID NO: 62958 - RNA, 1698 nt, Artificial Sequence; identical to SEQ ID NO: 62922
  derived and/or modified sequence opt1 from hemagglutinin__InfluenzaA__ABV30184

SEQ ID NO: 62959 - RNA, 1701 nt, Artificial Sequence; identical to SEQ ID NO: 62936
  derived and/or modified sequence opt1 from hemagglutinin__InfluenzaA__ABV30217

SEQ ID NO: 62960 - RNA, 1701 nt, Artificial Sequence; identical to SEQ ID NO: 62936
  derived and/or modified sequence opt1 from hemagglutinin__InfluenzaA__ABV30228

SEQ ID NO: 62961 - RNA, 1701 nt, Artificial Sequence
  derived and/or modified sequence opt1 from hemagglutinin__InfluenzaA__ABV30261
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagguggaggucacgaacgccaccgagcuggugcagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgucccggacuacgcgagccugcggucccucguggccagcuccgggacgcuggaguucaacaacgagagcuucaacugggccggcgugacccagaacgggaccuccagcgccugcaagcgcggcuccaacaacagcuucuucucccggcugaacuggcucacccacagcaaguucaaguaccccgcgcugaacgucacgaugcccaacaacgaggaguucgacaagcuguacaucuggggcgugcaccaccccgggaccgacaacgaccagaucuuccucuacgcccaggccuccggccgcaucaccgugagcaccaagcggagccagcagacggucaucccgaacaucgggucccgcccccgggugcgcaacauccccagccggaucuccaucuacuggaccaucgugaagcccggcgacauccugcugaucaacagcaccgggaaccucaucgccccgcgcggcuacuucaagauccgguccggcaagagcuccaucaugcgcagcgacgcccccaucgggaagugcaacuccgagugcaucacccccaacggcagcauccccaacgacaagccguuccagaacgucaaccggaucacguacggggcgugcccccgcuacgugaagcagaacacccugaagcuggccaccggcaugcggaacgugcccgagaagcagacccgcgggaucuucggcgccaucgccggcuucaucgagaacgggugggagggcauggucgacgggugguacggcuuccggcaccagaacuccgaggggaugggccaggccgcggaccucaagagcacgcaggccgccaucgaccagaucaacggcaagcugaaccgccugaucgggaagaccaacgagaaguuccaccagaucgagaaggaguucuccgagguggagggccggauccaggaccucgagaaguacguggaggacaccaagaucgaccuguggagcuacaacgccgagcugcucgucgcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccggaacggcaccuacgaccacgacguguaccgcgccgaggcccugaacaaccgcuuccagaucaagggcguggagcucaaguccggguacaaggacuggauccuguggaucagcuucgccaucuccugcuuccugcucugcgucgcgcugcugggcuucaucaugugggccugccagaaggggaacauccggugcaacaucugcaucuga

SEQ ID NO: 62962 - RNA, 1701 nt, Artificial Sequence
  derived and/or modified sequence opt1 from hemagglutinin__InfluenzaA__ABV30272
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucuccaagcugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 62963 - RNA, 1698 nt, Artificial Sequence
  derived and/or modified sequence opt1 from hemagglutinin__InfluenzaA__ABV30283
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcaacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucgacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugccggaucugcaucuga

SEQ ID NO: 62964 - RNA, 1698 nt, Artificial Sequence
  derived and/or modified sequence opt1 from hemagglutinin__InfluenzaA__ABV30294
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugagcuccuucgagcgcuucgagaucuucccgaaggagagcuccuggcccaaccacaccgucaccggggugagcgccuccugcagccacaacggcaaguccagcuucuaccggaaccugcuguggcucaccgggaagaacggccuguaccccaaccugucccgcagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcgucuaccagauccuggccaucuacuccacgguggccagcagccucgugcugcuggucucccucggggccaucagcuucuggaugugcuccaacggcagccugcagugccggaucugcaucuga

SEQ ID NO: 62965 - RNA, 1698 nt, Artificial Sequence
  derived and/or modified sequence opt1 from hemagglutinin__InfluenzaA__ABV30305
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggggcuccgccagcugcucccacaacggcaagagcuccuucuaccgcaaccugcuguggcucaccgggaagaacgggcuguaccccaaccugagcaaguccuacgccaacaacaaggagaaggaggugcucgugcuguggggcguccaccacccgcccaacaucggcgaccagcgggcccuguaccacacggagaacgccuacgugagcguggucagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgcgguucgccuucgcccucucccgcggcuucggcagcgggaucaucacguccaacgcccccauggacgagugcgacgcgaagugccagacgccccagggcgccaucaacagcucccugcccuuccagaacgugcacccggucaccaucggggagugccccaaguacgugcggagcaccaagcugcgcauggugaccggccuccggaacauccccuccauccagagccgcgggcuguucggcgccaucgccggcuucaucgagggcggguggaccgggauggucgacggcugguacggguaccaccaccagaacgagcagggcuccggcuacgccgcggaccagaaguccacccagaacgccaucaacgggaucaccaacaaggugaacagcgugaucgagaagaugaacacgcaguucaccgccgucggcaaggaguucaacaagcuggagcggcgcauggagaaccucaacaagaagguggacgacggguuccuggacaucuggaccuacaacgccgagcugcucguccugcuggagaacgagcggacccucgacuuccacgacagcaacgugaagaaccuguacgagaaggugaagucccagcugaagaacaacgccaaggagaucggcaacgggugcuucgaguucuaccacaagugcaacaacgagugcauggagagcgucaagaacggcacguacgacuaccccaaguacuccgaggagagcaagcucaaccgcgagaagaucgacggcgugaagcuggaguccauggggguguaccagauccuggcgaucuacagcaccgucgccagcucccucgugcugcuggugagccucggcgccaucuccuucuggaugugcagcaacgggucccugcagugccggaucugcaucuga

SEQ ID NO: 62966 - RNA, 1698 nt, Artificial Sequence; identical to SEQ ID NO: 62918
  derived and/or modified sequence opt1 from hemagglutinin__InfluenzaA__ABV30316

SEQ ID NO: 62967 - RNA, 1698 nt, Artificial Sequence; identical to SEQ ID NO: 62964
  derived and/or modified sequence opt1 from hemagglutinin__InfluenzaA__ABV30327

SEQ ID NO: 62968 - RNA, 1698 nt, Artificial Sequence; identical to SEQ ID NO: 62918
  derived and/or modified sequence opt1 from hemagglutinin__InfluenzaA__ABV30338

SEQ ID NO: 62969 - RNA, 1698 nt, Artificial Sequence; identical to SEQ ID NO: 62922
  derived and/or modified sequence opt1 from hemagglutinin__InfluenzaA__ABV30349

SEQ ID NO: 62970 - RNA, 1698 nt, Artificial Sequence
  derived and/or modified sequence opt1 from hemagglutinin__InfluenzaA__ABV30360
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcaacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucgacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcaucaagcuggaguccaugggcguguaccagauccuggccaucuacagcacggucgccagcucccucgugcugcuggugagccucggggccaucuccuucuggaugugcagcaacggcucccugcagugccggaucugcaucuga

SEQ ID NO: 62971 - RNA, 1698 nt, Artificial Sequence; identical to SEQ ID NO: 62922
  derived and/or modified sequence opt1 from hemagglutinin__InfluenzaA__ABV30371

SEQ ID NO: 62972 - RNA, 1701 nt, Artificial Sequence; identical to SEQ ID NO: 62737
  derived and/or modified sequence opt1 from hemagglutinin__InfluenzaA__ABV30382

SEQ ID NO: 62973 - RNA, 1701 nt, Artificial Sequence; identical to SEQ ID NO: 61638
  derived and/or modified sequence opt1 from hemagglutinin__InfluenzaA__ABV30393

SEQ ID NO: 62974 - RNA, 1701 nt, Artificial Sequence
  derived and/or modified sequence opt1 from hemagglutinin__InfluenzaA__ABV30404
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaagugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgaccuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 62975 - RNA, 1701 nt, Artificial Sequence
  derived and/or modified sequence opt1 from hemagglutinin__InfluenzaA__ABV30415
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacugggccggcgugacccagaacgggaccuccagcgccugcaagcgcggcuccaacaacagcuucuucucccggcugaacuggcucacccacagcaaguucaaguaccccgcgcugaacgugacgaugcccaacaacgaggaguucgacaagcuguacaucuggggcguccaccaccccgggaccgacaacgaccagaucuuccucuacgcccaggccuccggccgcaucaccgugagcaccaagcggagccagcagacggugaucccgaacaucgggucccgcccccggguccgcaacauccccagccggaucuccaucuacuggaccaucgugaagcccggcgacauccugcugaucaacagcaccgggaaccucaucgccccgcgcggcuacuucaagauccgguccggcaagagcuccaucaugcgcagcgacgcccccaucgggaagugcaacuccgagugcaucacccccaacggcagcauccccaacgacaagccguuccagaacgugaaccggaucacguacggggcgugcccccgcuacgucaagcagaacacccugaagcuggccaccggcaugcggaacgugcccgagaagcagacccgcgggaucuucggcgccaucgccggcuucaucgagaacgggugggagggcaugguggacgggugguacggcuuccggcaccagaacuccgaggggaucggccaggccgcggaccucaagagcacgcaggccgccaucgaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgcgagaacgcggaggacauggggaacggcugcuucaagaucuaccacaagugcgacaacgccugcaucgggagcauccggaacggcaccuacgaccacgacgucuaccgcgacgaggcccugaacaaccgcuuccagaucaaguccguggagcucaagagcggcuacaaggacuggauccuguggaucuccuucgccaucagcugcuuccugcucugcguggcccugcugggguucaucaugugggcgugccagaagggcaacauccggugcaacaucugcaucuga

SEQ ID NO: 62976 - RNA, 1701 nt, Artificial Sequence; identical to SEQ ID NO: 62936
  derived and/or modified sequence opt1 from hemagglutinin__InfluenzaA__ABV30426

SEQ ID NO: 62977 - RNA, 1701 nt, Artificial Sequence
  derived and/or modified sequence opt1 from hemagglutinin__InfluenzaA__ABV30437
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaaccacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 62978 - RNA, 1701 nt, Artificial Sequence; identical to SEQ ID NO: 62936
  derived and/or modified sequence opt1 from hemagglutinin__InfluenzaA__ABV30448

SEQ ID NO: 62979 - RNA, 1698 nt, Artificial Sequence
  derived and/or modified sequence opt1 from hemagglutinin__InfluenzaA__ABV30459
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgaggcccccaaccccgagaacgggaccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggcgaccagcgggcccuguaccacaccgagaacgccuacgugagcguggucagcucccacuacagccgccgguucacgcccgagaucgcgaagcgccccaaggugcgggaccaggagggccgcaucaacuacuacuggacccuccuggagcccggggacaccaucaucuucgaggccaacggcaaccugaucgccccgcgguucgccuucgcccucucccgcggguucggcagcggcaucaucaccuccaacgcgcccauggacgagugcgacgccaagugccagacgccccagggggccaucaacagcucccugcccuuccagaacgugcacccggucaccaucggcgagugccccaaguacgugcggagcaccaagcugcgcauggugaccgggcuccggaacauccccuccauccagagccgcggccuguucggggccaucgccggcuucaucgagggcggguggacgggcauggucgacgggugguacggcuaccaccaccagaacgagcagggguccggcuacgcggccgaccagaaguccacccagaacgccaucaacggcaucaccaacaaggugaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcucaaccgcgagaagaucgacggcgugaagcuggaguccaugggcguguaccagauccuggccaucuacagcacggucgccagcucccucgugcugcuggugagccucggggccaucuccuucuggaugugcagcaacggcucccugcagugccggaucugcaucuga

SEQ ID NO: 62980 - RNA, 1701 nt, Artificial Sequence; identical to SEQ ID NO: 62936
  derived and/or modified sequence opt1 from hemagglutinin__InfluenzaA__ABV30470

SEQ ID NO: 62981 - RNA, 1698 nt, Artificial Sequence; identical to SEQ ID NO: 62918
  derived and/or modified sequence opt1 from hemagglutinin__InfluenzaA__ABV30492

SEQ ID NO: 62982 - RNA, 1698 nt, Artificial Sequence
  derived and/or modified sequence opt1 from hemagglutinin__InfluenzaA__ABV30503
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccaucaccgggguguccgccagcugcucccacaacggcaagagcuccuucuaccgcaaccugcuguggcucaccgggaagaacggccuguaccccaaccugagcaaguccuacgccaacaacaaggagaaggagguccucgugcuguggggcgugcaccacccgcccaacaucggggaccagcgggcccuguaccacacggagaacgccuacgucagcguggugagcucccacuacagccgccgguucacccccgagaucgccaagcgccccaagguccgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggugaccaucggcgagugccccaaguacguccggagcaccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgcgagaagaucgacggcgucaagcuggaguccaugggcguguaccagauccuggcgaucuacagcaccguggccagcucccucguccugcuggugagccucggggccaucuccuucuggaugugcagcaacggcucccugcagugccggaucugcaucuga

SEQ ID NO: 62983 - RNA, 1701 nt, Artificial Sequence; identical to SEQ ID NO: 62936
  derived and/or modified sequence opt1 from hemagglutinin__InfluenzaA__ABV30514

SEQ ID NO: 62984 - RNA, 1698 nt, Artificial Sequence
  derived and/or modified sequence opt1 from hemagglutinin__InfluenzaA__ABV30525
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacagcggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacacccccaugggggagugcgacgccaagugccagacgccccagggcgcgaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcagcggcuacgccgcggaccagaaguccacccagaacgccaucaacgggaucaccaacaaggugaacagcgucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcacguacgacuaccccaaguacagcgaggaguccaagcucaaccgcgagaagaucgacggcgugaagcuggagagcaugggggucuaccagauccuggcgaucuacagcaccguggccuccagccucgugcugcuggucucccucggcgccaucagcuucuggaugugcuccaacgggagccugcagugccggaucugcaucuga

SEQ ID NO: 62985 - RNA, 1698 nt, Artificial Sequence; identical to SEQ ID NO: 62922
  derived and/or modified sequence opt1 from hemagglutinin__InfluenzaA__ABV30536

SEQ ID NO: 62986 - RNA, 1698 nt, Artificial Sequence; identical to SEQ ID NO: 62929
  derived and/or modified sequence opt1 from hemagglutinin__InfluenzaA__ABV30547

SEQ ID NO: 62987 - RNA, 1698 nt, Artificial Sequence; identical to SEQ ID NO: 62922
  derived and/or modified sequence opt1 from hemagglutinin__InfluenzaA__ABV30558

SEQ ID NO: 62988 - RNA, 1698 nt, Artificial Sequence
  derived and/or modified sequence opt1 from hemagglutinin__InfluenzaA__ABV30569
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacaaccacaacgggaagcucugccugcugaagggcaucgcgccccuccagcuggggaacugcagcguggccggcuggauccuggggaacccggagugcgagcuccugaucuccaaggagagcugguccuacaucgucgagacccccaaccccgagaacggcacgugcuaccccggcuacuucgccgacuacgaggagcugcgcgagcagcucagcuccgugagcuccuucgagcgguucgagaucuucccgaaggagagcuccuggcccaaccacaccgugaccggggucagcgccuccugcagccacaacggcaaguccagcuucuaccgcaaccugcuguggcucaccgggaagaacggccuguaccccaaccuguccaagagcuacgccaacaacaaggagaaggaggugcucgugcuguggggcguccaccacccgcccaacaucggggaccagcgggcccuguaccacacggagaacgccuacguguccguggucagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccagccugcccuuccagaacgugcacccggucaccaucggcgagugccccaaguacgugcgguccaccaagcugcgcauggugaccgggcuccggaacauccccagcauccagucccgcggccuguucggggccaucgccggcuucaucgagggcggguggaccggcauggucgacgggugguacggcuaccaccaccagaacgagcaggggagcggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggacguacgacuaccccaaguacagcgaggaguccaagcucaaccgcgagaagaucgacggcgugaagcuggagagcaugggcguguaccagauccuggcgaucuacuccaccgucgccagcagccucgugcugcuggugucccucggggccaucagcuucuggaugugcuccaacggcagccugcagugccggaucugcaucuga

SEQ ID NO: 62989 - RNA, 1698 nt, Artificial Sequence; identical to SEQ ID NO: 62922
  derived and/or modified sequence opt1 from hemagglutinin__InfluenzaA__ABV30580

SEQ ID NO: 62990 - RNA, 1698 nt, Artificial Sequence; identical to SEQ ID NO: 62918
  derived and/or modified sequence opt1 from hemagglutinin__InfluenzaA__ABV30591

SEQ ID NO: 62991 - RNA, 1698 nt, Artificial Sequence; identical to SEQ ID NO: 62918
  derived and/or modified sequence opt1 from hemagglutinin__InfluenzaA__ABV30602

SEQ ID NO: 62992 - RNA, 1698 nt, Artificial Sequence
  derived and/or modified sequence opt1 from hemagglutinin__InfluenzaA__ABV30613
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcggcgcaugaagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagagcaagcucaaccgcgagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccggaucugcaucuga

SEQ ID NO: 62993 - RNA, 1698 nt, Artificial Sequence; identical to SEQ ID NO: 62918
  derived and/or modified sequence opt1 from hemagglutinin__InfluenzaA__ABV30624

SEQ ID NO: 62994 - RNA, 1701 nt, Artificial Sequence
  derived and/or modified sequence opt1 from hemagglutinin__InfluenzaA__ABV30646
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccuacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 62995 - RNA, 1701 nt, Artificial Sequence
  derived and/or modified sequence opt1 from hemagglutinin__InfluenzaA__ABV30657
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagguguuccuguacgcgcaggccagcgggcggaucaccguguccacgaagcgcagccagcagaccgucaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 62996 - RNA, 1701 nt, Artificial Sequence; identical to SEQ ID NO: 62995
  derived and/or modified sequence opt1 from hemagglutinin__InfluenzaA__ABV45860

SEQ ID NO: 62997 - RNA, 1698 nt, Artificial Sequence; identical to SEQ ID NO: 62963
  derived and/or modified sequence opt1 from hemagglutinin__InfluenzaA__ABV45871

SEQ ID NO: 62998 - RNA, 1698 nt, Artificial Sequence; identical to SEQ ID NO: 62922
  derived and/or modified sequence opt1 from hemagglutinin__InfluenzaA__ABV45882

SEQ ID NO: 62999 - RNA, 1698 nt, Artificial Sequence; identical to SEQ ID NO: 62929
  derived and/or modified sequence opt1 from hemagglutinin__InfluenzaA__ABV45893

SEQ ID NO: 63000 - RNA, 1701 nt, Artificial Sequence; identical to SEQ ID NO: 62737
  derived and/or modified sequence opt1 from hemagglutinin__InfluenzaA__ABV45904

SEQ ID NO: 63001 - RNA, 1698 nt, Artificial Sequence; identical to SEQ ID NO: 62929
  derived and/or modified sequence opt1 from hemagglutinin__InfluenzaA__ABV45926

SEQ ID NO: 63002 - RNA, 1698 nt, Artificial Sequence
  derived and/or modified sequence opt1 from hemagglutinin__InfluenzaA__ABV45937
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgagacgaacggcaaccugaucgcgccgcgguucgccuucgcccucucccgcggguucggcagcggcaucaucaccuccaacgcccccaugggggagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgccgcggaccagaaguccacccagaacgccaucaacgggaucaccaacaaggugaacagcgucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgccaaggagaucggcaacgggugcuucgaguucuaccacaagugcaacgacgagugcauggagagcgugaagaacggcacguacgacuaccccaaguacuccgaggagagcaagcucaaccgcgagaagaucgacggcgugaagcuggaguccaugggggucuaccagauccuggcgaucuacagcaccguggccagcucccucgugcugcuggucagccucggcgccaucuccuucuggaugugcagcaacgggucccugcagugccggaucugcaucuga

SEQ ID NO: 63003 - RNA, 1698 nt, Artificial Sequence; identical to SEQ ID NO: 62955
  derived and/or modified sequence opt1 from hemagglutinin__InfluenzaA__ABV45948

SEQ ID NO: 63004 - RNA, 1698 nt, Artificial Sequence; identical to SEQ ID NO: 62922
  derived and/or modified sequence opt1 from hemagglutinin__InfluenzaA__ABV45959

SEQ ID NO: 63005 - RNA, 1701 nt, Artificial Sequence
  derived and/or modified sequence opt1 from hemagglutinin__InfluenzaA__ABV45970
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggaccacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccagagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 63006 - RNA, 1701 nt, Artificial Sequence
  derived and/or modified sequence opt1 from hemagglutinin__InfluenzaA__ABV45981
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggaucaucuggaucuccuucgccaucagcugcuuccugcucugcguggcccugcugggcuucaucaugugggccugccagaaggggaacauccgcugcaacaucugcaucuga

SEQ ID NO: 63007 - RNA, 1698 nt, Artificial Sequence
  derived and/or modified sequence opt1 from hemagglutinin__InfluenzaA__ABV82551
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcgagagcuccuucuaccgcaaccugcuguggcucaccgagaagaacgggcuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggcgacaccaucaucuucgaggcgaacgggaaccugaucgccccgcgguucgccuucgcccucucccgcggcuucgggagcggcaucaucacguccaacgcccccauggacaagugcgacgcgaagugccagacgccccagggcgccaucaacagcucccugcccuuccagaacguccacccggugaccaucggggagugccccaaguacgugcggagcaccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacccagaacgccaucaacggcaucaccaacaaggugaacagcgucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgccaaggagaucggcaacgggugcuucgaguucuaccacaagugcaacgacgagugcauggagagcgugaagaacggcacguacgacuaccccaaguacuccgaggagagcaagcucaaccgcgagaagaucgacggggugaagcuggaguccaugggcgucuaccagauccuggcgaucuacagcaccguggccagcucccucgugcugcuggucagccucggcgccaucuccuucuggaugugcagcaacgggucccugcagugccggaucugcaucuga

SEQ ID NO: 63008 - RNA, 1701 nt, Artificial Sequence; identical to SEQ ID NO: 62936
  derived and/or modified sequence opt1 from hemagglutinin__InfluenzaA__ABV82562

SEQ ID NO: 63009 - RNA, 1701 nt, Artificial Sequence; identical to SEQ ID NO: 62936
  derived and/or modified sequence opt1 from hemagglutinin__InfluenzaA__ABW36168

SEQ ID NO: 63010 - RNA, 1698 nt, Artificial Sequence; identical to SEQ ID NO: 62922
  derived and/or modified sequence opt1 from hemagglutinin__InfluenzaA__ABW36179

SEQ ID NO: 63011 - RNA, 1698 nt, Artificial Sequence; identical to SEQ ID NO: 62965
  derived and/or modified sequence opt1 from hemagglutinin__InfluenzaA__ABW36190

SEQ ID NO: 63012 - RNA, 1698 nt, Artificial Sequence; identical to SEQ ID NO: 62922
  derived and/or modified sequence opt1 from hemagglutinin__InfluenzaA__ABW36201

SEQ ID NO: 63013 - RNA, 1698 nt, Artificial Sequence
  derived and/or modified sequence opt1 from hemagglutinin__InfluenzaA__ABW36212
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggagaacuccuggcccaaccacaccgucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcgggcugggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcuccgcauggucaccgggcugcggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcucgagcggcgcauggagaaccugaacaagaaggucgacgacggcuuccuggacaucuggaccuacaacgccgagcuccuggugcugcucgagaacgagcggacccuggacuuccacgacuccaacgugaagaaccuguacgagaaggucaaggggcagcucaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgugaagcuggaguccaugggggucuaccagauccucgccaucuacagcacgguggccuccagccuggugcugcucgucagccugggcgccaucuccuucuggaugugcagcaacgggucccugcagugccggaucugcaucuga

SEQ ID NO: 63014 - RNA, 1698 nt, Artificial Sequence; identical to SEQ ID NO: 62918
  derived and/or modified sequence opt1 from hemagglutinin__InfluenzaA__ABW36223

SEQ ID NO: 63015 - RNA, 1698 nt, Artificial Sequence; identical to SEQ ID NO: 62918
  derived and/or modified sequence opt1 from hemagglutinin__InfluenzaA__ABW36245

SEQ ID NO: 63016 - RNA, 1698 nt, Artificial Sequence; identical to SEQ ID NO: 62918
  derived and/or modified sequence opt1 from hemagglutinin__InfluenzaA__ABW36267

SEQ ID NO: 63017 - RNA, 1698 nt, Artificial Sequence; identical to SEQ ID NO: 62922
  derived and/or modified sequence opt1 from hemagglutinin__InfluenzaA__ABW36278

SEQ ID NO: 63018 - RNA, 1698 nt, Artificial Sequence
  derived and/or modified sequence opt1 from hemagglutinin__InfluenzaA__ABW36289
augaagcugaagcuccuggugcugcucugcaccuucaccgccacguacgccgacaccaucugcaucggcuaccacgcgaacaacagcaccgacaccgucgacacggugcuggagaagaacgugaccgucacccacuccgugaaccugcucgaggacagccacaacgggaagcugugccugcucaagggcaucgcgccccugcagcuggggaacugcuccguggccggcuggauccucgggaacccggagugcgagcugcugaucagcaaggaguccuggagcuacaucgucgagacccccaaccccgagaacggcacgugcuaccccggcuacuucgccgacuacgaggagcuccgcgagcagcuguccagcguguccagcuucgagcgguucgagaucuucccgaaggaguccagcuggcccaaccacaccgugaccggggucuccgccagcugcucccacaacggcaagagcuccuucuaccgcaaccugcucuggcugaccgggaagaacggccuguaccccaaccucagcaaguccuacgccaacaacaaggagaaggaggugcuggugcuguggggcguccaccacccgcccaacaucggggaccagcgggcccucuaccacacggagaacgccuacgugagcguggucagcucccacuacagccgccgguucacccccgagaucgccaagcgccccaaggugcgggaccaggagggccgcaucaacuacuacuggacccugcuggagcccggggacaccaucaucuucgaggcgaacggcaaccucaucgccccgcgguucgccuucgcccugucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcaccaagcuccgcauggugaccgggcugcggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcucgagcggcgcauggagaaccugaacaagaagguggacgacggcuuccuggacaucuggaccuacaacgccgagcuccugguccugcucgagaacgagcggacccuggacuuccacgacagcaacgugaagaaccuguacgagaaggugaagucccagcucaagaacaacgccaaggagaucgggaacggcugcuucgaguucuaccacaagugcaacgacgagugcauggagagcgucaagaacgggacguacgacuaccccaaguacuccgaggagagcaagcugaaccgcgagaagaucgacggcgugaagcuggaguccaugggcguguaccagauccucgcgaucuacagcaccgucgccagcucccuggugcugcucgugagccugggggccaucuccuucuggaugugcagcaacggcucccugcagugccggaucugcaucuga

SEQ ID NO: 63019 - RNA, 1698 nt, Artificial Sequence; identical to SEQ ID NO: 62929
  derived and/or modified sequence opt1 from hemagglutinin__InfluenzaA__ABW36300

SEQ ID NO: 63020 - RNA, 1701 nt, Artificial Sequence
  derived and/or modified sequence opt1 from hemagglutinin__InfluenzaA__ABW36311
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagcggagcuggccgaagcacaacgucacccgcggggugacggccuccugcagccacaagggcaaguccagcuucuaccggaaccuccuguggcugaccgagaagaacggguccuaccccaaccucagcaagagcuacgugaacaacaaggagaaggagguccuggugcuguggggcgugcaccaccccuccaacaucgaggaccagaagaccaucuaccgcaaggagaacgccuacgucagcgugguguccagcaacuacaaccggcgcuucacccccgagaucgcgaagcggccgaagguccgcgaccaggaggggcggaucaacuacuacuggacgcuccuggagcccggcgacaccaucaucuucgaggccaacggcaaccugaucgcccccugguacgccuucgcccucucccgcggguucggcagcgggaucaucaccuccaacgcgagcauggacgagugcgacaccaagugccagacgccccagggcgccaucaacuccagccugccguuccagaacgugcaccccgugaccaucggcgagugccccaaguacguccgguccaccaagcugcgcauggugaccgggcuccggaacauccccagcauccagucccgcggccuguucggggccaucgccggcuucaucgagggcggcuggacgggcaugaucgacgggugguacggcuaccaccaccagaacgagcaggggagcggcuacgccgcggaccagaaguccacccagaacgccaucaacgggaucaccaacaaggugaacagcgucaucgagaagaugaacacccaguucacggccgugggcaaggaguucaacaagcuggagaagcggauggagaaccucaacaagaagguggacgacggcuuccuggacaucuggaccuacaacgccgagcugcucguccugcuggagaacgagcgcacccucgacucccacgacagcaacgugaagaaccuguacgagaaggucaagucccagcugaagaacaacgccaaggagaucgggaacggcugcuucgaguucuaccacaagugcaacaacgagugcauggagagcgugaagaacgggaccuacgacuacccgaaguacagcgaggaguccaagcucaaccgggagaagaucgacggcgugaagcuggagagcaugggggucuaccagauccuggcgaucuacuccacgguggccagcucccucgugcugcuggucagccucggcgccaucuccuucuggaugugcagcaacggcucccugcagugccgcaucugcaucuga

SEQ ID NO: 63021 - RNA, 1701 nt, Artificial Sequence
  derived and/or modified sequence opt1 from hemagglutinin__InfluenzaA__ABW38363
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcucaucguggcccuggagaaccagcacacgaucgaccugaccgacagcgagaugaacaagcuguucgagcggaccaagaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 63022 - RNA, 1698 nt, Artificial Sequence
  derived and/or modified sequence opt1 from hemagglutinin__InfluenzaA__ABW39777
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggagaacuccuggcccaaccacaccgucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcgggcugggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcuccgcauggucaccgggcugcggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcucgagcggcgcauggagaaccugaacaagaaggucgacgacggcuuccuggacaucuggaccuacaacgccgagcuccuggugcugcucgagaacgagcggacccuggacuuccacgacuccaacgugaagaaccuguacgagaaggucaagagccagcucaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcuggagagcaugggcgucuaccagauccucgccaucuacuccacgguggccagcagccuggugcugcucgucucccugggggccaucagcuucuggaugugcuccaacggcagccugcagugccggaucugcaucuga

SEQ ID NO: 63023 - RNA, 1698 nt, Artificial Sequence; identical to SEQ ID NO: 62922
  derived and/or modified sequence opt1 from hemagglutinin__InfluenzaA__ABW39806

SEQ ID NO: 63024 - RNA, 1698 nt, Artificial Sequence; identical to SEQ ID NO: 62929
  derived and/or modified sequence opt1 from hemagglutinin__InfluenzaA__ABW39817

SEQ ID NO: 63025 - RNA, 1698 nt, Artificial Sequence
  derived and/or modified sequence opt1 from hemagglutinin__InfluenzaA__ABW39828
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugagcuccuucgagcgguucgagaucuucccgaaggagagcuccuggcccaaccacacggucaccggggugagcgccuccugcagccacaacggcgaguccagcuucuacaagaaccugcuguggcucaccgggaagaacggccuguaccccaaccuguccaagagcuacgccaacaacaaggagaaggaggugcucguccuguggggcgugcaccacccgcccaacaucggcgaccagaugacccuguaccacaaggagaacgccuacguguccgucgugagcagccacuacucccgcaaguucacgcccgagaucgccaagcggcccaaggugcgcgaccaggagggccggaucaacuacuacuggacccuccuggagcccggggacaccaucaucuucgaggccaacggcaaccugaucgcgccgcgcuacgccuucgcccucagccggggguucggcuccggcaucaucaacagcaacgcccccauggacgagugcgacgccaagugccagacgccccagggggcgaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacguguggaccuacaacgccgagcugcuggugcuccuggagaacgagcgcacgcuggacuuccacgacuccaacgucaagaaccucuacgagaaggugaagaaccagcugaagaacaacgccaaggagaucgggaacggcugcuucgaguucuaccacaagugcaacgacgagugcauggagagcgugaagaacgggaccuacgacuaccccaaguacuccgaggagagcaagcugucccgggagaagaucgacggcgucaagcucgagagcaugggcguguaccagauccuggcgaucuacuccaccguggccagcagccugguccuccuggugucccugggggccaucagcuucuggaugugcuccaacggcagccuccagugccgcaucugcaucuga

SEQ ID NO: 63026 - RNA, 1698 nt, Artificial Sequence
  derived and/or modified sequence opt1 from hemagglutinin__InfluenzaA__ABW39839
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacagcaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggccaacggcaaccugaucgcgccgcgguucgccuucgcccucagccgcggguucggcuccggcaucaucacgagcaacgcccccaugggggagugcgacgccaagugccagacgccccagggcgcgaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcagcggcuacgccgcggaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgccaaggagaucggcaacgggugcuucgaguucuaccacaagugcaacgacgagugcauggaguccgugcgcaacggcaccuacgacuaccccaaguacagcgaggaguccaagcucaaccgggagaagaucgacggcgugaagcuggagagcaugggggucuaccagauccuggcgaucuacagcacgguggccuccagccucgugcugcuggucucccucggcgccaucagcuucuggaugugcuccaacgggagccugcagugccgcaucugcaucuga

SEQ ID NO: 63027 - RNA, 1698 nt, Artificial Sequence
  derived and/or modified sequence opt1 from hemagglutinin__InfluenzaA__ABW39850
augaaggugaagcugcucguccugcugugcaccuucaccgccacgaacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaaggggcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggcgugaagcucgagagcaugggggucuaccagauccuggccaucuacuccaccguggccagcagccuggugcuccuggucucccugggcgccaucagcuucuggaugugcuccaacgggagccuccagugccggaucugcaucuga

SEQ ID NO: 63028 - RNA, 1698 nt, Artificial Sequence; identical to SEQ ID NO: 62953
  derived and/or modified sequence opt1 from hemagglutinin__InfluenzaA__ABW39861

SEQ ID NO: 63029 - RNA, 1701 nt, Artificial Sequence; identical to SEQ ID NO: 62936
  derived and/or modified sequence opt1 from hemagglutinin__InfluenzaA__ABW39872

SEQ ID NO: 63030 - RNA, 1698 nt, Artificial Sequence
  derived and/or modified sequence opt1 from hemagglutinin__InfluenzaA__ABW39883
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccccacaacaucggggaccagcgggcccuguaccacacggagaacgccuacgugagcgucgugagcucccacuacagccgccgguucaccccggagaucgccaagcgccccaaggugcgggaccaggagggccgcaucaacuacuacuggacccuccuggagcccggggacaccaucaucuucgaggcgaacggcaaccugaucgcgccccgguucgccuucgcccucucccgcggguucggcagcggcaucaucacguccaacgccccgauggacgagugcgacgccaagugccagacgccccagggggccaucaacagcucccugcccuuccagaacguccaccccgugaccaucggcgagugcccgaaguacgugcggagcaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 63031 - RNA, 1698 nt, Artificial Sequence; identical to SEQ ID NO: 62963
  derived and/or modified sequence opt1 from hemagglutinin__InfluenzaA__ABW39894

SEQ ID NO: 63032 - RNA, 1698 nt, Artificial Sequence; identical to SEQ ID NO: 62918
  derived and/or modified sequence opt1 from hemagglutinin__InfluenzaA__ABW39905

SEQ ID NO: 63033 - RNA, 1698 nt, Artificial Sequence; identical to SEQ ID NO: 62922
  derived and/or modified sequence opt1 from hemagglutinin__InfluenzaA__ABW39927

SEQ ID NO: 63034 - RNA, 1701 nt, Artificial Sequence
  derived and/or modified sequence opt1 from hemagglutinin__InfluenzaA__ABW39938
augaagaccaucaucgcccugagcuacauccucugccugguguucgcccagaagauccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccgacaacgaccagaucuuccucuacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcugaucaacuccaccgggaaccucaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccucaaguccacccaggcggccaucgaccagaucaacgggaagcugaaccggcugaucggcaagaccaacgagaaguuccaccagaucgagaaggaguucagcgaggucgagggccgcauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacgccuaccgcgacgaggcccugaacaaccgguuccagaucaagggggucgagcucaagagcggcuacaaggacuggauccuguggaucuccuucgccaucagcugcuuccugcucugcguggcccugcugggcuucaucaugugggcgugccagaaggggaacauccgcugcaacaucugcaucuga

SEQ ID NO: 63035 - RNA, 1698 nt, Artificial Sequence; identical to SEQ ID NO: 62922
  derived and/or modified sequence opt1 from hemagglutinin__InfluenzaA__ABW39949

SEQ ID NO: 63036 - RNA, 1698 nt, Artificial Sequence; identical to SEQ ID NO: 62963
  derived and/or modified sequence opt1 from hemagglutinin__InfluenzaA__ABW39960

SEQ ID NO: 63037 - RNA, 1698 nt, Artificial Sequence; identical to SEQ ID NO: 62918
  derived and/or modified sequence opt1 from hemagglutinin__InfluenzaA__ABW39982

SEQ ID NO: 63038 - RNA, 1698 nt, Artificial Sequence; identical to SEQ ID NO: 62938
  derived and/or modified sequence opt1 from hemagglutinin__InfluenzaA__ABW39993

SEQ ID NO: 63039 - RNA, 1698 nt, Artificial Sequence; identical to SEQ ID NO: 62918
  derived and/or modified sequence opt1 from hemagglutinin__InfluenzaA__ABW40004

SEQ ID NO: 63040 - RNA, 1698 nt, Artificial Sequence; identical to SEQ ID NO: 62964
  derived and/or modified sequence opt1 from hemagglutinin__InfluenzaA__ABW40015

SEQ ID NO: 63041 - RNA, 1701 nt, Artificial Sequence; identical to SEQ ID NO: 62995
  derived and/or modified sequence opt1 from hemagglutinin__InfluenzaA__ABW40026

SEQ ID NO: 63042 - RNA, 1698 nt, Artificial Sequence; identical to SEQ ID NO: 62918
  derived and/or modified sequence opt1 from hemagglutinin__InfluenzaA__ABW40037

SEQ ID NO: 63043 - RNA, 1698 nt, Artificial Sequence
  derived and/or modified sequence opt1 from hemagglutinin__InfluenzaA__ABW40048
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagaaggcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcaccaagcugcggauggucaccgggcuccgcaacauccccuccauccagagccggggccuguucggggccaucgccggcuucaucgagggcggguggaccggcaugguggacgggugguacggcuaccaccaccagaacgagaagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 63044 - RNA, 1698 nt, Artificial Sequence; identical to SEQ ID NO: 62922
  derived and/or modified sequence opt1 from hemagglutinin__InfluenzaA__ABW40059

SEQ ID NO: 63045 - RNA, 1698 nt, Artificial Sequence
  derived and/or modified sequence opt1 from hemagglutinin__InfluenzaA__ABW40070
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucaagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacagcaagugccagacgccccagggggcgaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggcgaucuacagcaccguggccuccagccuggugcuccuggucucccugggggccaucagcuucuggaugugcuccaacggcagccuccagugccggaucugcaucuga

SEQ ID NO: 63046 - RNA, 1701 nt, Artificial Sequence; identical to SEQ ID NO: 62936
  derived and/or modified sequence opt1 from hemagglutinin__InfluenzaA__ABW40081

SEQ ID NO: 63047 - RNA, 1698 nt, Artificial Sequence
  derived and/or modified sequence opt1 from hemagglutinin__InfluenzaA__ABW40092
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucaagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagagcaagcucaaccgcgagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccggaucugcaucuga

SEQ ID NO: 63048 - RNA, 1698 nt, Artificial Sequence; identical to SEQ ID NO: 62965
  derived and/or modified sequence opt1 from hemagglutinin__InfluenzaA__ABW40103

SEQ ID NO: 63049 - RNA, 1698 nt, Artificial Sequence
  derived and/or modified sequence opt1 from hemagglutinin__InfluenzaA__ABW40114
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccaccagcugcucccacaacggcaagagcuccuucuaccgcaaccugcuguggcucacggggaagaacggccuguaccccaaccugagcaaguccuacgccaacaacaaggagaaggaggugcucgugcuguggggcguccaccacccgcccaacaucgggaaccagcgggcccuguaccacaccgagaacgccuacgugagcguggucagcucccacuacagccgccgguucacccccgagaucgccaagcgccccaaggugcgggaccaggagggccgcaucaacuacuacuggacccuccuggagcccggggacacgaucaucuucgaggccaacggcaaccugaucgcgccgcgguucgccuucgcccucucccgcggguucggcagcggcaucaucaccuccaacgcccccauggacgagugcgacgccaagugccagacgccccagggggcgaucaacagcucccugcccuuccagaacgugcacccggucaccaucggcgagugccccaaguacgugcggagcaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgccgaccagaaguccacccagaacgcgaucaacggcaucacgaacaaggugaacagcgugaucgagaagaugaacacccaguucaccgccgucgggaaggaguucaacaagcuggagcggcgcauggagaaccucaacaagaagguggacgacggcuuccuggacaucuggaccuacaacgccgagcugcucguccugcuggagaacgagcggacgcucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcucaaccgcgagaagaucgacggcgugaagcuggaguccaugggcguguaccagauccuggccaucuacagcaccgucgcgagcucccucgugcugcuggugagccucggggccaucuccuucuggaugugcagcaacggcucccugcagugccggaucugcaucuga

SEQ ID NO: 63050 - RNA, 1698 nt, Artificial Sequence; identical to SEQ ID NO: 62918
  derived and/or modified sequence opt1 from hemagglutinin__InfluenzaA__ABW40125

SEQ ID NO: 63051 - RNA, 1701 nt, Artificial Sequence; identical to SEQ ID NO: 62936
  derived and/or modified sequence opt1 from hemagglutinin__InfluenzaA__ABW40136

SEQ ID NO: 63052 - RNA, 1698 nt, Artificial Sequence; identical to SEQ ID NO: 62953
  derived and/or modified sequence opt1 from hemagglutinin__InfluenzaA__ABW40147

SEQ ID NO: 63053 - RNA, 1698 nt, Artificial Sequence; identical to SEQ ID NO: 62922
  derived and/or modified sequence opt1 from hemagglutinin__InfluenzaA__ABW40158

SEQ ID NO: 63054 - RNA, 1698 nt, Artificial Sequence; identical to SEQ ID NO: 62922
  derived and/or modified sequence opt1 from hemagglutinin__InfluenzaA__ABW40180

SEQ ID NO: 63055 - RNA, 1701 nt, Artificial Sequence; identical to SEQ ID NO: 62936
  derived and/or modified sequence opt1 from hemagglutinin__InfluenzaA__ABW40191

SEQ ID NO: 63056 - RNA, 1698 nt, Artificial Sequence; identical to SEQ ID NO: 62938
  derived and/or modified sequence opt1 from hemagglutinin__InfluenzaA__ABW40202

SEQ ID NO: 63057 - RNA, 1698 nt, Artificial Sequence; identical to SEQ ID NO: 62918
  derived and/or modified sequence opt1 from hemagglutinin__InfluenzaA__ABW40213

SEQ ID NO: 63058 - RNA, 1698 nt, Artificial Sequence; identical to SEQ ID NO: 62918
  derived and/or modified sequence opt1 from hemagglutinin__InfluenzaA__ABW40224

SEQ ID NO: 63059 - RNA, 1698 nt, Artificial Sequence; identical to SEQ ID NO: 62922
  derived and/or modified sequence opt1 from hemagglutinin__InfluenzaA__ABW40235

SEQ ID NO: 63060 - RNA, 1701 nt, Artificial Sequence
  derived and/or modified sequence opt1 from hemagglutinin__InfluenzaA__ABW40246
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagguguuccuguacgcgcaggccagcgggcggaucaccguguccacgaagcgcagccagcagaccgucaucccgaacaucggcagccggccccgcgugcggaacauccccucccgcaucagcaucuacuggaccaucgugaagcccggcgacauccugcucaucaacuccaccgggaaccugaucgccccgcggggcuacuuccgcauccggagcgggaaguccagcaucaugcgcuccgacgcccccaucggcaagugcaacagcgagugcaucacgcccaacggcuccauccccaacgacaagccguuccagaacgucaaccggaucaccuacggggccugcccccgcuacgugaagcagaacacccugaagcucgcgaccggcaugcggaacgugcccgagaagcagacgcgcgggaucuucggcgccaucgccggguucaucgagaacggcugggagggcauggucgacgggugguacggcuuccggcaccagaacagcgaggggaucggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 63061 - RNA, 1698 nt, Artificial Sequence
  derived and/or modified sequence opt1 from hemagglutinin__InfluenzaA__ABW40257
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcaucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgcgagaagaucgacggcgucaagcuggaguccaugggcguguaccagauccuggcgaucuacagcaccguggccagcucccucguccugcuggugagccucggggccaucuccuucuggaugugcagcaacggcucccugcagugccggaucugcaucuga

SEQ ID NO: 63062 - RNA, 1701 nt, Artificial Sequence; identical to SEQ ID NO: 62995
  derived and/or modified sequence opt1 from hemagglutinin__InfluenzaA__ABW40268

SEQ ID NO: 63063 - RNA, 1698 nt, Artificial Sequence
  derived and/or modified sequence opt1 from hemagglutinin__InfluenzaA__ABW40312
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggccgcagcuccuucuaccggaaccugcuguggcucaccgggaagaacggccuguaccccaaccugagcaaguccuacgccaacaacaaggagaaggaggugcucguccuguggggcgugcaccacccgcccaacaucggggaccagcgcgcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcaccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 63064 - RNA, 1701 nt, Artificial Sequence; identical to SEQ ID NO: 62936
  derived and/or modified sequence opt1 from hemagglutinin__InfluenzaA__ABW40323

SEQ ID NO: 63065 - RNA, 1698 nt, Artificial Sequence; identical to SEQ ID NO: 62964
  derived and/or modified sequence opt1 from hemagglutinin__InfluenzaA__ABW40334

SEQ ID NO: 63066 - RNA, 1698 nt, Artificial Sequence; identical to SEQ ID NO: 62964
  derived and/or modified sequence opt1 from hemagglutinin__InfluenzaA__ABW40345

SEQ ID NO: 63067 - RNA, 1698 nt, Artificial Sequence
  derived and/or modified sequence opt1 from hemagglutinin__InfluenzaA__ABW40356
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucgucauguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccugcucgagcccggggacaccaucaucuucgaggcgaacggcaaccugaucgccccgcgguucgccuucgcccugucccgcggguucggcagcggcaucaucacguccaacgcccccaugggggagugcgacgcgaagugccagacgccccagggcgccaucaacagcucccuccccuuccagaacguccacccggugaccaucggggagugccccaaguacgugcggagcgccaagcugcgcauggucaccggccugcggaacauccccuccauccagagccgcggccucuucggggccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccugaacaagaaggucgacgacggguuccucgacaucuggaccuacaacgccgagcugcuggugcuccuggagaacgagcggacccuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgugaagcucgaguccaugggggucuaccagauccuggccaucuacagcacgguggccagcucccuggugcuccuggucagccugggcgccaucuccuucuggaugugcagcaacgggucccuccagugccggaucugcaucuga

SEQ ID NO: 63068 - RNA, 1698 nt, Artificial Sequence; identical to SEQ ID NO: 62922
  derived and/or modified sequence opt1 from hemagglutinin__InfluenzaA__ABW40367

SEQ ID NO: 63069 - RNA, 1701 nt, Artificial Sequence; identical to SEQ ID NO: 62936
  derived and/or modified sequence opt1 from hemagglutinin__InfluenzaA__ABW40378

SEQ ID NO: 63070 - RNA, 1698 nt, Artificial Sequence; identical to SEQ ID NO: 62922
  derived and/or modified sequence opt1 from hemagglutinin__InfluenzaA__ABW40389

SEQ ID NO: 63071 - RNA, 1698 nt, Artificial Sequence; identical to SEQ ID NO: 62918
  derived and/or modified sequence opt1 from hemagglutinin__InfluenzaA__ABW40400

SEQ ID NO: 63072 - RNA, 1698 nt, Artificial Sequence; identical to SEQ ID NO: 62918
  derived and/or modified sequence opt1 from hemagglutinin__InfluenzaA__ABW40411

SEQ ID NO: 63073 - RNA, 1698 nt, Artificial Sequence; identical to SEQ ID NO: 62918
  derived and/or modified sequence opt1 from hemagglutinin__InfluenzaA__ABW40422

SEQ ID NO: 63074 - RNA, 1698 nt, Artificial Sequence; identical to SEQ ID NO: 62964
  derived and/or modified sequence opt1 from hemagglutinin__InfluenzaA__ABW40433

SEQ ID NO: 63075 - RNA, 1698 nt, Artificial Sequence; identical to SEQ ID NO: 62938
  derived and/or modified sequence opt1 from hemagglutinin__InfluenzaA__ABW40444

SEQ ID NO: 63076 - RNA, 1698 nt, Artificial Sequence; identical to SEQ ID NO: 62955
  derived and/or modified sequence opt1 from hemagglutinin__InfluenzaA__ABW40455

SEQ ID NO: 63077 - RNA, 1698 nt, Artificial Sequence; identical to SEQ ID NO: 62922
  derived and/or modified sequence opt1 from hemagglutinin__InfluenzaA__ABW40466

SEQ ID NO: 63078 - RNA, 1698 nt, Artificial Sequence; identical to SEQ ID NO: 62922
  derived and/or modified sequence opt1 from hemagglutinin__InfluenzaA__ABW40477

SEQ ID NO: 63079 - RNA, 1698 nt, Artificial Sequence; identical to SEQ ID NO: 62918
  derived and/or modified sequence opt1 from hemagglutinin__InfluenzaA__ABW40488

SEQ ID NO: 63080 - RNA, 1698 nt, Artificial Sequence; identical to SEQ ID NO: 62922
  derived and/or modified sequence opt1 from hemagglutinin__InfluenzaA__ABW40499

SEQ ID NO: 63081 - RNA, 1698 nt, Artificial Sequence; identical to SEQ ID NO: 62964
  derived and/or modified sequence opt1 from hemagglutinin__InfluenzaA__ABW40510

SEQ ID NO: 63082 - RNA, 1698 nt, Artificial Sequence; identical to SEQ ID NO: 62918
  derived and/or modified sequence opt1 from hemagglutinin__InfluenzaA__ABW40521

SEQ ID NO: 63083 - RNA, 1698 nt, Artificial Sequence; identical to SEQ ID NO: 62922
  derived and/or modified sequence opt1 from hemagglutinin__InfluenzaA__ABW40532

SEQ ID NO: 63084 - RNA, 1698 nt, Artificial Sequence
  derived and/or modified sequence opt1 from hemagglutinin__InfluenzaA__ABW40543
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaccuccaaggagagcugguccuacaucguggagacgcccaaccccgagaacgggaccugcuaccccggcuacuucgccgacuacgaggagcugcgggagcagcucagcuccgugagcuccuucgagcgcuucgagaucuucccgaaggagagcuccuggcccaaccacaccgucaccggggugagcgccuccugcagccacaacggcaaguccagcuucuaccggaaccugcuguggcucacggggaagaacggccuguaccccaaccuguccaagagcuacgccaacaacaaggagaaggaggugcucguccuguggggcgugcaccacccgcccaacaucggcgaccagcgcgcccuguaccacaccgagaacgccuacguguccgucgugagcagccacuacucccggcgcuucacccccgagaucgccaagcggcccaaggugcgcgaccaggagggccggaucaacuacuacuggacccuccuggagcccggggacacgaucaucuucgaggcgaacggcaaccugaucgccccgcgcuucgccuucgcccucagccggggguucggcuccggcaucaucaccagcaacgcccccauggacgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggacguacgacuaccccaaguacagcgaggaguccaagcucaaccgggagaagaucgacggcgugaagcuggagagcaugggcgucuaccagauccuggccaucuacuccaccguggccagcagccucgugcugcuggucucccucggggccaucagcuucuggaugugcuccaacggcagccugcagugccgcaucugcaucuga

SEQ ID NO: 63085 - RNA, 1698 nt, Artificial Sequence; identical to SEQ ID NO: 63063
  derived and/or modified sequence opt1 from hemagglutinin__InfluenzaA__ABW40554

SEQ ID NO: 63086 - RNA, 1698 nt, Artificial Sequence; identical to SEQ ID NO: 62922
  derived and/or modified sequence opt1 from hemagglutinin__InfluenzaA__ABW40565

SEQ ID NO: 63087 - RNA, 1698 nt, Artificial Sequence
  derived and/or modified sequence opt1 from hemagglutinin__InfluenzaA__ABW40576
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacaccuacgugagcguggucagcucccacuacagccgccgguucacccccgagaucgccaagcgccccaaggugcgggaccaggagggccgcaucaacuacuacuggacccuccuggagcccggggacacgaucauccuggaggccaacggcaaccucaucgcgccgcgguucgccuucgcccugucccgcggguucggcagcggcaucaucaccuccaacgcccccauggacgagugcgacgccaagugccagacgccccagggggcgaucaacagcucccugcccuuccagaacgugcacccggucaccaucggcgagugccccaaguacgugcggagcaccaagcuccgcauggugaccgggcugcggaacauccccuccauccagagccgcggccuguucggggccaucgccggcuucaucgagggcggguggaccggcauggucgacgggugguacggcuaccaccaccagaacgagcagggguccggcuacgccgccgaccagaaguccacccagaacgcgaucaacggcaucacgaacaaggugaacagcgugaucgagaagaugaacacccaguucaccgccgucgggaaggaguucaacaagcucgagcggcgcauggagaaccugaacaagaagguggacgacggcuuccuggacaucuggaccuacaacgccgagcuccugguccugcucgagaacgagcggacgcuggacuuccacgacagcaacgugaagaaccuguacgagaaggugaagucccagcucaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcuggaguccaugggcguguaccagauccucgccaucuacagcaccgucgcgagcucccuggugcugcucgugagccugggggccaucuccuucuggaugugcagcaacggcucccugcagugccggaucugcaucuga

SEQ ID NO: 63088 - RNA, 1701 nt, Artificial Sequence; identical to SEQ ID NO: 62995
  derived and/or modified sequence opt1 from hemagglutinin__InfluenzaA__ABW40587

SEQ ID NO: 63089 - RNA, 1698 nt, Artificial Sequence; identical to SEQ ID NO: 62964
  derived and/or modified sequence opt1 from hemagglutinin__InfluenzaA__ABW40598

SEQ ID NO: 63090 - RNA, 1698 nt, Artificial Sequence; identical to SEQ ID NO: 62938
  derived and/or modified sequence opt1 from hemagglutinin__InfluenzaA__ABW40609

SEQ ID NO: 63091 - RNA, 1698 nt, Artificial Sequence; identical to SEQ ID NO: 62953
  derived and/or modified sequence opt1 from hemagglutinin__InfluenzaA__ABW40620

SEQ ID NO: 63092 - RNA, 1701 nt, Artificial Sequence; identical to SEQ ID NO: 62995
  derived and/or modified sequence opt1 from hemagglutinin__InfluenzaA__ABW40631

SEQ ID NO: 63093 - RNA, 1698 nt, Artificial Sequence; identical to SEQ ID NO: 62918
  derived and/or modified sequence opt1 from hemagglutinin__InfluenzaA__ABW40642

SEQ ID NO: 63094 - RNA, 1701 nt, Artificial Sequence; identical to SEQ ID NO: 62995
  derived and/or modified sequence opt1 from hemagglutinin__InfluenzaA__ABW40653

SEQ ID NO: 63095 - RNA, 1698 nt, Artificial Sequence; identical to SEQ ID NO: 62964
  derived and/or modified sequence opt1 from hemagglutinin__InfluenzaA__ABW40664

SEQ ID NO: 63096 - RNA, 1698 nt, Artificial Sequence; identical to SEQ ID NO: 62938
  derived and/or modified sequence opt1 from hemagglutinin__InfluenzaA__ABW40675

SEQ ID NO: 63097 - RNA, 1698 nt, Artificial Sequence; identical to SEQ ID NO: 63067
  derived and/or modified sequence opt1 from hemagglutinin__InfluenzaA__ABW71294

SEQ ID NO: 63098 - RNA, 1698 nt, Artificial Sequence; identical to SEQ ID NO: 62964
  derived and/or modified sequence opt1 from hemagglutinin__InfluenzaA__ABW71305

SEQ ID NO: 63099 - RNA, 1698 nt, Artificial Sequence
  derived and/or modified sequence opt1 from hemagglutinin__InfluenzaA__ABW71316
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagccccgggacaccaucaucuucgaggcgaacgggaaccugaucgccccgcgcuucgccuucgcccucucccggggcuucgggagcggcaucaucacguccaacgcccccauggacgagugcgacgcgaagugccagacgccccagggcgccaucaacagcucccugcccuuccagaacgugcacccggucaccaucggggagugccccaaguacgugcgcagcaccaagcugcggauggugaccggccuccgcaacauccccuccauccagagccgggggcuguucggcgccaucgccggguucaucgagggcggcuggaccgggauggucgacggcugguacggguaccaccaccagaacgagcagggcuccggguacgccgcggaccagaaguccacccagaacgccaucaacggcaucaccaacaaggugaacagcgugaucgagaagaugaacacgcaguucaccgccgucggcaaggaguucaacaagcuggagcgccggauggagaaccucaacaagaagguggacgacggguuccuggacaucuggaccuacaacgccgagcugcucguccugcuggagaacgagcgcacccucgacuuccacgacagcaacgugaagaaccuguacgagaaggugaagucccagcugaagaacaacgccaaggagaucggcaacgggugcuucgaguucuaccacaagugcaacgacgagugcauggagagcgucaagaacggcacguacgacuaccccaaguacuccgaggagagcaagcucaaccgggagaagaucgacggggugaagcuggaguccaugggcguguaccagauccuggcgaucuacagcaccgucgccagcucccucgugcugcuggugagccucggcgccaucuccuucuggaugugcagcaacgggucccugcagugccgcaucugcaucuga

SEQ ID NO: 63100 - RNA, 1698 nt, Artificial Sequence; identical to SEQ ID NO: 62918
  derived and/or modified sequence opt1 from hemagglutinin__InfluenzaA__ABW71327

SEQ ID NO: 63101 - RNA, 1698 nt, Artificial Sequence; identical to SEQ ID NO: 62922
  derived and/or modified sequence opt1 from hemagglutinin__InfluenzaA__ABW71338

SEQ ID NO: 63102 - RNA, 1701 nt, Artificial Sequence; identical to SEQ ID NO: 62936
  derived and/or modified sequence opt1 from hemagglutinin__InfluenzaA__ABW71349

SEQ ID NO: 63103 - RNA, 1698 nt, Artificial Sequence
  derived and/or modified sequence opt1 from hemagglutinin__InfluenzaA__ABW71360
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugagcuccuucgagcgcuucgagaucuucccgaaggagagcuccuggcccaaccacaccgucaccggggugagcgccuccugcagccacaacggcaaguccagcuucuaccggaaccugcuguggcucaccgggaagaacggccuguaccccaaccugucccgcagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcgacgacgagugcauggaguccgugaagaacgggaccuacgacuaccccaaguacagcgaggaguccaagcucaaccgcgagaagaucgacggcgugaagcuggagagcaugggcgucuaccagauccuggccaucuacuccacgguggccagcagccucgugcugcuggucucccucggggccaucagcuucuggaugugcuccaacggcagccugcagugccggaucugcaucuga

SEQ ID NO: 63104 - RNA, 1698 nt, Artificial Sequence; identical to SEQ ID NO: 62938
  derived and/or modified sequence opt1 from hemagglutinin__InfluenzaA__ABW71371

SEQ ID NO: 63105 - RNA, 1698 nt, Artificial Sequence
  derived and/or modified sequence opt1 from hemagglutinin__InfluenzaA__ABW71382
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcugguccaaccacaccaucaccggggugagcgccuccugcagccacaacggcaaguccagcuucuaccgcaaccugcuguggcucaccgggaagaacggccuguaccccaaccuguccaagagcuacgccaacaacaaggagaaggagguccucgugcuguggggcgugcaccacccgcccaacaucggggaccagcgggcccuguaccacacggagaacgccuacgucagcgugguguccagccacuacucccgccgguucacccccgagaucgccaagcgccccaagguccgggaccaggagggccgcaucaacuacuacuggacccuccuggagcccggggacaccaucaucuucgaggcgaacggcaaccugaucgcgccccgguucgccuucgcccucagccgcggguucggcuccggcaucaucacgagcaacgccccgauggacgagugcgacgccaagugccagacgccccagggggccaucaacuccagccugcccuuccagaacgugcaccccgugaccaucggcgagugcccgaaguacguccgguccaccaagcugcgcauggugaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggucaacagcgugaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgucaagaaccuguacgagaaggucaagagccagcugaagaacaacgccaaggagaucgggaacggcugcuucgaguucuaccacaagugcaacgacgagugcauggaguccgugaagaacgggacguacgacuaccccaaguacagcgaggaguccaagcucaaccgcgagaagaucgacggcgugaagcuggagagcaugggcguguaccagauccuggcgaucuacagcaccguggccuccagccucguccugcuggugucccucggggccaucagcuucuggaugugcuccaacggcagccugcagugccggaucugcaucuga

SEQ ID NO: 63106 - RNA, 1698 nt, Artificial Sequence
  derived and/or modified sequence opt1 from hemagglutinin__InfluenzaA__ABW71393
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucaccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucacggggaagaacggccuguaccccaaccugagcaaguccuacgccaacaacaaggagaaggaggugcucguccuguggggcgugcaccacccgcccaacaucggggaccagcgggcccuguaccacaccgagaacgccuacgugagcgucgugagcucccacuacagccgccgguucacccccgagaucgccaagcgccccaaggugcgggaccaggagggccgcaucaacuacuacuggacccuccuggagcccggggacacgaucaucuucgaggccaacggcaaccugaucgcgccgcgguucgccuucgcccucucccgcggguucggcagcggcaucaucaccuccaacgcccccaugggggagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgccgcggaccagaaguccacccagaacgccaucaacgggaucaccaacaaggugaacagcgucaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgccaaggagaucggcaacgggugcuucgaguucuaccacaagugcaacgacgagugcauggagagcgugaagaacggcacguacgacuaccccaaguacuccgaggagagcaagcucaaccgcgagaagaucgacggcgugaagcuggaguccaugggggucuaccagauccuggcgaucuacagcaccguggccagcucccucgugcugcuggucagccucggcgccaucuccuucuggaugugcagcaacgggucccugcagugccggaucugcaucuga

SEQ ID NO: 63107 - RNA, 1698 nt, Artificial Sequence; identical to SEQ ID NO: 63067
  derived and/or modified sequence opt1 from hemagglutinin__InfluenzaA__ABW71404

SEQ ID NO: 63108 - RNA, 1698 nt, Artificial Sequence; identical to SEQ ID NO: 62955
  derived and/or modified sequence opt1 from hemagglutinin__InfluenzaA__ABW71415

SEQ ID NO: 63109 - RNA, 1698 nt, Artificial Sequence
  derived and/or modified sequence opt1 from hemagglutinin__InfluenzaA__ABW71426
augaaggccaagcugcucauccugcugugcaccuucaccgccacguacgcggacaccaucugcaucggcuaccacgccaacaacagcaccgacaccguggacacgguccucgagaagaacgugaccgugacccacuccgucaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcgucuccagcuucgagcgguucgagaucuucccgaaggaguccagcuggcccaaccacaccgugaccgggguguccgccagcugcucccacaacggcaagagcuccuucuaccgcaaccugcuguggcucaccgggaagaacggccuguaccccaaccugagcaaguccuacgccaacaacaaggagaaggagguccucgugcuguggggcgugcaccacccgcccaacaucggggaccagcgggcccuguaccacacggagaacgccuacgucagcguggugagcucccacuacagccgccgguucacccccgagaucgcgaagcgccccaagguccgggaccaggagggccgcaucaacuacuacuggacccuccuggagcccggggacaccaucaucuucgaggccaacggcaaccugaucgccccgcgguucgccuucgcccucucccgcggguucggcagcggcaucaucacguccaacgcgcccauggacgagugcgacgccaagugccagacgccccagggggccaucaacagcucccugcccuuccagaacgugcacccggugaccaucggcgagugccccaaguacguccggagcaccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggucaacagcgugaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgcgaaggagaucgggaacggcugcuucgaguucuaccacaagugcaacgacgagugcauggagagcgugaagaacgggacguacgacuaccccaaguacuccgaggagagcaagcucaaccgcgagaagaucgacggcgucaagcuggaguccaugggcguguaccagauccuggccaucuacagcaccguggccagcucccucguccugcuggugagccucggggccaucuccuucuggaugugcagcaacggcucccugcagugccggaucugcaucuga

SEQ ID NO: 63110 - RNA, 1698 nt, Artificial Sequence
  derived and/or modified sequence opt1 from hemagglutinin__InfluenzaA__ABW71448
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgcgagaagaucgacggcgugaagcuggaguccaugggcgucuaccagauccuggcgaucuacagcaccaucgccagcucccucgugcugcuggugagccucggggccaucuccuucuggaugugcagcaacggcucccugcagugccggaucugcaucuga

SEQ ID NO: 63111 - RNA, 1698 nt, Artificial Sequence; identical to SEQ ID NO: 62938
  derived and/or modified sequence opt1 from hemagglutinin__InfluenzaA__ABW71459

SEQ ID NO: 63112 - RNA, 1698 nt, Artificial Sequence; identical to SEQ ID NO: 62922
  derived and/or modified sequence opt1 from hemagglutinin__InfluenzaA__ABW71470

SEQ ID NO: 63113 - RNA, 1707 nt, Artificial Sequence
  derived and/or modified sequence opt1 from hemagglutinin__InfluenzaA__ABW74702
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccaccaacgaccugugcuaccccggguccuucaacgacuacgaggagcugaagcaccuccugagccggaucaaccacuucgagaagauccagaucaucccgaaguccagcugguccgaccacgaggccagcuccggcgucagcuccgccugccccuaccugggcagcuccagcuucuuccgcaacgugguguggcucaucaagaagaacuccacguaccccaccaucaagaaguccuacaacaacaccaaccaggaggaccugcugguccucugggggauccaccaccccaacgacgcggccgagcagacccggcuguaccagaacccgacgaccuacaucagcaucggcaccagcacccugaaccagcgccucgugcccaagaucgccacgcggagcaaggugaacgggcaguccggccgcauggaguucuucuggaccauccugaagcccaacgacgccaucaacuucgagagcaacgggaacuucaucgcgcccgaguacgccuacaagaucgucaagaagggcgacuccgccaucaugaaguccgagcuggaguacggcaacugcaacaccaagugccagaccccgaugggggccaucaacagcagcaugcccuuccacaacauccacccccucacgaucggcgagugccccaaguacgugaaguccaaccggcuggugcuggccaccgggcuccgcaacagcccgcagcgggagucccgccggaagaagcgcggccuguucggcgcgaucgccggguucaucgagggcggguggcagggcauggucgacgggugguacggcuaccaccacagcaacgagcagggcuccggguacgccgccgacaaggagagcacccagaaggccaucgacggcgugaccaacaaggugaacuccaucaucgacaagaugaacacgcaguucgaggcggucgggcgggaguucaacaaccuggagcgccggaucgagaaccucaacaagaagauggaggacggcuuccuggacguguggaccuacaacgccgagcugcucgugcugauggagaacgagcgcacccuggacuuccacgacagcaacgucaagaaccucuacgacaaggugcggcugcagcugcgcgacaacgccaaggagcucgggaacggcugcuucgaguucuaccacaagugcgacaacgagugcaucgaguccauccggaacggcaccuacaacuacccccaguacagcgaggaggcccgccugaagcgggaggagaucuccggggucaagcuggagagcaucggcacguaccagauccucuccaucuacagcaccguggccagcucccuggcgcuggccaucaugauggccgggcucagccuguggaugugcuccaacggcagccugcagugccgcaucugcaucuga

SEQ ID NO: 63114 - RNA, 1707 nt, Artificial Sequence
  derived and/or modified sequence opt1 from hemagglutinin__InfluenzaA__ABW74703
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugaaggacugcuccgucgccggguggcugcucggcaacccgaugugcgacgaguucaucaacgugcccgaguggagcuacaucguggagaaggccaaccccaccaacgaccugugcuaccccggguccuucaacgacuacgaggagcugaagcaccuccugagccgcaucaaccacuucgagaagauccagaucaucccgaaguccagcugguccgaccacgaggccagcuccggcgucagcuccgccugccccuaccugggcagccccuccuucuuccggaacgugguguggcucaucaagaagaacagcacguaccccaccaucaagaaguccuacaacaacaccaaccaggaggaccugcugguccucugggggauccaccacccgaacgacgcggccgagcagacccgccuguaccagaaccccacgaccuacaucagcaucggcaccuccacccugaaccagcggcucgugcccaagaucgccacgcgcagcaaggugaacgggcagagcggccggauggaguucuucuggaccauccugaagcccaacgacgccgucaacuucgaguccaacgggaacuucaucgcgccggaguacgccuacaagaucgugaagaagggcgacagcgccaucaugaaguccgagcuggaguacggcaacugcaacaccaagugccagacccccaugggggccaucaacagcuccaugcccuuccacaacauccacccccucacgaucggcgagugcccgaaguacgugaaguccaaccgccugguccuggccaccgggcuccggaacagcccccagcgcgagagccggcgcaagaagcggggccuguucggcgcgaucgccggguucaucgagggcggguggcagggcaugguggacgggugguacggcuaccaccacuccaacgagcagggcagcggguacgccgccgacaaggaguccacccagaaggccaucgacggcgugaccaacaaggucaacagcaucaucgacaagaugaacacgcaguucgaggcgguggggcgcgaguucaacucccuggagcggcgcaucgagaaccucaacaagaagauggaggacggcuuccuggacguguggaccuacaacgccgagcugcucguccugauggagaacgagcggacccuggacuuccacgacagcaacgugaagaaccucuacgacaagguccgccugcagcugcgggacaacgccaaggagcucgggaacggcugcuucgaguucuaccacaagugcgacaacgagugcauggaguccauccgcaacggcaccuacaacuacccccaguacagcgaggaggcccggcugaagcgcgaggagaucuccggggugaagcuggagagcaucggcacguaccagauccucuccaucuacagcaccguggccagcucccuggcgcuggccaucaugaucgccgggcucagccuguggaugugcuccaacggcagccugcagugccggaucugcaucuga

SEQ ID NO: 63115 - RNA, 1707 nt, Artificial Sequence
  derived and/or modified sequence opt1 from hemagglutinin__InfluenzaA__ABW74705
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccaccaacgaccugugcuaccccggguccuucaacgacuacgaggagcugaagcaccuccugagccggaucaaccacuucgagaagauccagaucaucccgaaguccagcugguccgaccacgaggccagcuccggcgucagcuccgccugccccuaccugggcagccccuccuucuuccgcaacgugguguggcucaucaagaagaacagcacguaccccaccaucaagaaguccuacaacaacaccaaccaggaggaccugcugguccucugggggauccaccacccgaacgacgcggccgagcagacccggcuguaccagaaccccacgaccuacaucagcaucggcaccuccacccugaaccagcgccucgugcccaagaucgccacgcggagcaaggugaacgggcagagcggccgcauggaguucuucuggaccauccugaagcccaacgacgccaucaacuucgaguccaacgggaacuucaucgcgccggaguacgccuacaagaucgucaagaagggcgacagcgccaucaugaaguccgagcuggaguacggcaacugcaacaccaagugccagacccccaugggggccaucaacagcuccaugcccuuccacaacauccacccccucacgaucggcgagugcccgaaguacgugaaguccaaccggcuggugcuggccaccgggcuccgcaacagcccccagcgggagagccgccggaagaagcgcggccuguucggcgcgaucgccggguucaucgagggcggguggcagggcauggucgacgggugguacggcuaccaccacuccaacgagcagggcagcggguacgccgccgacaaggaguccacccagaaggccaucgacggcgugaccaacaaggugaacagcaucaucgacaagaugaacacgcaguucgaggcggucgggcgggaguucaacaaccuggagcgccggaucgagaaccucaacaagaagauggaggacggcuuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacaacgagugcauggagagcauccggaacggcaccuacaacuacccccaguacuccgaggaggcccgccugaagcgggaggagaucagcggggucaagcuggaguccaucggcacguaccagauccucagcaucuacuccaccguggccagcagccuggcgcuggccaucaugaucgccgggcucucccuguggaugugcagcaacggcucccugcagugccgcaucugcaucuga

SEQ ID NO: 63116 - RNA, 1707 nt, Artificial Sequence
  derived and/or modified sequence opt1 from hemagglutinin__InfluenzaA__ABW74707
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccaccaacgaccugugcuaccccggguccuucaacgacuacgaggagcugaagcaccuccugagccggaucaaccacuucgagaagauccagaucaucccgaaguccagcugguccgaccacgaggccagcuccggcgucagcuccgccugccccuaccugggcagccccuccuucuuccgcaacgugguguggcucaucaagaagaacagcacguaccccaccaucaagaaguccuacaacaacaccaaccaggaggaccugcugguccucugggggauccaccacccgaacgacgcggccgagcagacccggcuguaccagaaccccacgaccuacaucagcaucggcaccuccacccugaaccagcgccucgugcccaagauggccacgcggagcaaggugaacgggcagagcggccgcauggaguucuucuggaccauccugaagcccaacgacgccaucaacuucgaguccaacgggaacuucaucgcgccggaguacgccuacaagaucgucaagaagggcgacagcgccaucaugaaguccgagcuggaguacggcaacugcaacaccaagugccagacccccaugggggccaucaacagcuccaugcccuuccacaacauccacccccucacgaucggcgagugcccgaaguacgugaaguccaaccggcuggugcuggccaccgggcuccgcaacagcccccagcgggagagccgccggaagaagcgcggccuguucggcgcgaucgccggguucaucgagggcggguggcagggcauggucgacgggugguacggcuaccaccacuccaacgagcagggcagcggguacgccgccgacaaggaguccacccagaaggccaucgacggcgugaccaacaaggugaacagcaucaucgacaagaugaacacgcaguucgaggcggucgggcgggaguucaacaaccuggagcgccggaucgagaaccucaacaagaagauggaggacggcuuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccacaagugcgacaacgagugcauggagagcauccggaacggcaccuacaacuacccccaguacuccgaggaggcccgccugaagcgggaggagaucagcggggucaagcuggaguccaucggcacguaccagauccucagcaucuacuccaccguggccagcagccuggcgcuggccaucaugaucgccgggcucucccuguggaugugcagcaacggcucccugcagugccgcaucugcaucuga

SEQ ID NO: 63117 - RNA, 1707 nt, Artificial Sequence
  derived and/or modified sequence opt1 from hemagglutinin__InfluenzaA__ABW74708
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccaccaacgaccugugcuaccccggguccuucaacgacuacgaggagcugaagcaccuccugagccggaucaaccacuucgagaagauccagaucaucccgaaguccagcugguccgaccacgaggccagcuccggcgucagcuccgccugccccuaccugggcagccccuccuucuuccgcaacgugguguggcucaucaagaagaacagcacguaccccaccaucaagaaguccuacaacaacaccaaccaggaggaccugcugguccucugggggauccaccacccgaacgacgcggccgagcagacccggcuguaccagaaccccacgaccuacaucagcaucggcaccuccacccugaaccagcgccucgugcccaagaucgccacgcggagcaaggugaacgggcagagcggccgcauggaguucuucuggaccauccugaagcccaacgacgccaucaacuucgaguccaacgggaacuucaucgcgccggaguacgccuacaagaucgucaagaagggcgacagcgccaucaugaaguccgagcuggaguacggcaacugcaacaccaagugccagacccccaugggggccaucaacagcuccaugcccuuccacaacauccacccccucacgaucggcgagugcccgaaguacgucaagagcaaccgguccgugcuggccaccgggcugcgcaacagcccccagcgggagucccgccggaagaagcgcggccucuucggcgcgaucgccggguucaucgagggcggguggcagggcaugguggacgggugguacggcuaccaccacagcaacgagcagggcuccggguacgccgccgacaaggagagcacccagaaggccaucgacggcgugaccaacaaggugaacuccaucaucgacaagaugaacacgcaguucgaggcggucgggcgggaguucaacaaccuggagcgccggaucgagaaccugaacaagaagauggaggacggcuuccucgacguguggaccuacaacgccgagcugcuggugcucauggagaacgagcgcacccuggacuuccacgacagcaacgucaagaaccuguacgacaaggugcggcuccagcugcgcgacaacgccaaggagcuggggaacggcugcuucgaguucuaccacaagugcgacaacgagugcauggaguccauccggaacggcaccuacaacuacccccaguacagcgaggaggcccgccucaagcgggaggagaucuccggggucaagcuggagagcaucggcacguaccagauccuguccaucuacagcaccguggccagcucccucgcgcuggccaucaugauggccgggcugagccucuggaugugcuccaacggcagccugcagugccgcaucugcaucuga

SEQ ID NO: 63118 - RNA, 1707 nt, Artificial Sequence; identical to SEQ ID NO: 63115
  derived and/or modified sequence opt1 from hemagglutinin__InfluenzaA__ABW74710

SEQ ID NO: 63119 - RNA, 1707 nt, Artificial Sequence; identical to SEQ ID NO: 63115
  derived and/or modified sequence opt1 from hemagglutinin__InfluenzaA__ABW74711

SEQ ID NO: 63120 - RNA, 1707 nt, Artificial Sequence
  derived and/or modified sequence opt1 from hemagglutinin__InfluenzaA__ABW74712
auggagaagaucgugcugcuccugagcaucgucucccuggucaagagcgaccagaucugcaucggcuaccacgccaacaacuccaccgagcaggucgacaccaucauggagaagaacgugacggugacccacgcccaggacauccucgagaagacccacaacgggaagcugugcgaccuggacggcgugaagccccucauccugcgcgacugcagcguggcgggguggcugcucggcaacccgaugugcgacgaguucaucaacgugcccgagugguccuacaucguggagaaggccaaccccaccaacgaccugugcuaccccgggagcuucaacgacuacgaggagcugaagcaccuccugucccggaucaaccacuucgagaagauccagaucauccccaagagcuccuggagcgaccacgaggccuccagcggcgucuccagcgccugcccguaccugggcucccccagcuucuuccgcaacgugguguggcucaucaagaagaacuccacguaccccaccaucaagaaguccuacaacaacaccaaccaggaggaccugcugguccucugggggauccaccacccgaacaacgaggaggagcagacccggcuguaccagaaccccacgaccuacaucagcaucggcaccagcacccugaaccagcgccucgugcccaagaucgccacgcggagcaaggugaacgggcaguccggccgcauggaguucuucuggaccauccugaagcccaacgacgcgaucaacuucgagagcaacgggaacuucaucgccccggaguacgccuacaagaucgucaagaagggcgacuccgccaucaugaaguccgagcuggaguacagcaacugcaacaccaagugccagacccccaugggcgcgaucaacagcuccaugcccuuccacaacauccacccccucacgaucggggagugcccgaaguacgucaagagcucccggcuggugcuggccaccggccuccgcaacagcccccagcgggagucccgccggaagaagcgcgggcuguucggcgccaucgccggcuucaucgagggcggguggcaggggaugguggacggcugguacggguaccaccacagcaacgagcagggcuccggcuacgccgcggacaaggagagcacccagaaggccaucgacggggugaccaacaaggugaacuccaucaucgacaagaugaacacgcaguucgaggccgucggccgggaguucaacaaccuggagcgccggaucgagaaccucaacaagaagauggaggacggguuccuggacguguggaccuacaacgccgagcugcucgugcugauggagaacgagcgcacccuggacuuccacgacagcaacgucaagaaccucuacgacaaggugcggcugcagcugcgcgacaacgccaaggagcucggcaacgggugcuucgaguucuaccacaagugcgacaacgagugcauggaguccauccggaacggcaccuacaacuacccccaguacagcgaggaggcgcgccugaagcgggaggagaucuccggcgucaagcuggagagcaucgggacguaccagauccucagcaucuacuccaccguggccagcucccuggcccuggccaucaugaucgccggccucagccuguggaugugcuccaacgggagccugcagugccgcaucugcaucuga

SEQ ID NO: 63121 - RNA, 1701 nt, Artificial Sequence
  derived and/or modified sequence opt1 from hemagglutinin__InfluenzaA__ABW80976
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccucccgcaucugcgacagcccccaccagauccuggacggggagaacugcacccugaucgacgcccuccugggcgacccccacugcgacggguuccagaacaaggagugggaccuguucguggagcgguccaaggccuacagcaacugcuaccccuacgacgugccggacuacgucucccuccgcagccugguggcguccagcggcacgcuggaguucaacaacgaguccuucaacuggaccggcguggcccagaacgggaccagcuccgccugcaagcggcgcagcgacaaguccuucuucagccggcucaacuggcugcaccagcugaaguacaaguaccccgcccucaacgucaccaugcccaacaacgagaaguucgacaagcuguacaucuggggcgugcaccaccccgggacggacuccgaccagaucagcaucuacgcgcaggccagcggccgcgugaccgucuccaccaagcggagccagcagaccgugaucccgaacaucgggucccgccccugggugcggggcgucagcuccggcaucagcaucuacuggacgaucgugaagcccggggacauccugcucaucaacuccaccggcaaccugaucgcgccccgcggguacuucaagauccggagcggcaaguccagcaucaugcgcuccgacgccccgaucggcaagugcaacagcgagugcaucacccccaacggguccauccccaacgacaagcccuuccagaacgugaaccggaucaccuacggcgccugcccgcgcuacgucaagcagaacacgcugaagcucgccaccgggaugcggaacgugcccgagaagcagacccgcggcaucuucggggccaucgccggcuucaucgagaacggcugggaggggaugauggacggcugguacggguuccggcaccagaacagcgagggcaccgggcaggccgccgaccugaaguccacgcaggcggccaucaaccagaucaacggcaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacaccaucgaccucacggacagcgagaugaacaagcuguucgagcgcaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaagggggucgagcucaagagcggcuacaaggacuggauccuguggaucagcuucgccaucuccugcuuccugcugugcaucgugcugcucggcuucaucaugugggccugccagaaggggaacauccgcugcaacaucugcaucuga

SEQ ID NO: 63122 - RNA, 1701 nt, Artificial Sequence
  derived and/or modified sequence opt1 from hemagglutinin__InfluenzaA__ABW80977
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucaaccuguacgcgcaggccagcggccggaucaccguguccacgaagcgcagccagcagaccgugaucccgaacaucggcagccggccccgcguccgggacgugcccucccgcaucagcaucuacuggaccaucgugaagcccggggacauccugcucaucuccagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 63123 - RNA, 1698 nt, Artificial Sequence
  derived and/or modified sequence opt1 from hemagglutinin__InfluenzaA__ABW80979
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgugaacaacaaggagaaggaggugcucguccuguggggcgugcaccacccgcccaacaucgggaaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 63124 - RNA, 1701 nt, Artificial Sequence
  derived and/or modified sequence opt1 from hemagglutinin__InfluenzaA__ABW81505
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccgccugaagggcaccgcgccccugcagcucgggaacugcuccaucgccggcuggauccuggggaacccggagugcgagagccuguucuccaaggagagcugguccuacaucgccgagacgcccaaccccaagaacgggaccugcuaccccggcuacuucgccgacuacgaggagcuccgggagcagcugagcuccgugagcuccuucgagcgcuucgagaucuucccgaaggacagcuccuggcccaaccacaccgucaccaagggggugacggccagcugcucccacaacggcaagagcuccuucuacaagaaccugcucuggcugaccgagaagaacgggcuguaccccaaccucagcaaguccuacgugaacaagaagggcaaggagguccuggugcuguggggcgugcaccaccccagcaacaugggcgaccagcgggccaucuaccacaaggagaacgccuacgucagcgugcucuccagccacuacucccgccgguucaccccggagaucgcgaagcgccccaaggugcgggaccaggagggccgcaucaacuacuacuggacccugcuggagcccggggacacgaucaucuucgaggccaacggcaaccucaucgcccccugguacgccuucgcccugagccggggguucggcuccggcaucaucaucagcaacgcguccaugggggagugcgacgccaagugccagaccccgcagggcgccaucaacagcucccugcccuuccagaacguccaccccgugaccaucggggagugccccaaguacgugcgcagcaccaagcuccggauggucacgggccugcgcaacgugccguccauccagagccgggggcuguucggcgccaucgccggcuucaucgagggcggguggaccgggaugaucgacggcugguacggguaccaccaccagaacgagcagggcuccggcuacgcggccgaccagaaguccacccagaacgccaucaacgggaucaccaacaaggugaacagcaucaucgagaagaugaacacgcaguucaccgccgucggcaaggaguucaacaagcucgagcgccggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagacgcagcucaagaacaacgcgaaggagaucggcaacgggugcuucgaguucuaccacaagugcaacaacgagugcauggaguccgucaagaacggcaccuacgacuaccccaaguacagcaaggaguccaagcugaaccgggagaagaucgacggcgugaagcuggagagcauggggguguaccagauccucgccaucuacagcaccgucgccuccagccuggugcugcucgugucccugggcgccaucagcuucuggaugugcuccaacgggagccugcagugccgcaucugcaucuga

SEQ ID NO: 63125 - RNA, 1698 nt, Artificial Sequence
  derived and/or modified sequence opt1 from hemagglutinin__InfluenzaA__ABW81506
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucgggaaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgugguacgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgugaagcuggaguccaugggcaucuaccagauccuggccaucuacagcacggucgccagcucccucgugcugcuggugagccucggggccaucuccuucuggaugugcagcaacggcucccugcagugccgcaucugcaucuga

SEQ ID NO: 63126 - RNA, 1701 nt, Artificial Sequence
  derived and/or modified sequence opt1 from hemagglutinin__InfluenzaA__ABW81507
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccgccugaagggcaccgugccccugcagcucgggaacugcuccaucgccggcuggauccuggggaacccggagugcgagagccuguucuccaaggagagcugguccuacaucgccgagacgcccaaccccaagaacgggaccugcuaccccggcuacuucgccgacuacgaggagcuccgggagcagcugagcuccgucagcuccuucgagcgcuucgagaucuucccgaaggacagcuccuggcccaaccacaccgugaccaagggggugacggcgagcugcucccacaacggcaagagcuccuucuacaagaaccugcucuggcugaccgagaagaacgggcuguaccccaaccucagcaaguccuacgucaacaagaagggcaaggaggugcuggugcuguggggcguccaccaccccagcaacaugggcgaccagcgggccaucuaccacaaggagaacgccuacgugagcgugcucuccagccacuacucccgccgguucaccccggagaucgccaagcgccccaagguccgggaccaggagggccgcaucaacuacuacuggacccugcuggagcccggggacacgaucaucuucgaggcgaacggcaaccucaucgcccccugguacgccuucgcccugagccggggguucggcuccggcaucaucaucagcaacgccuccaugggggagugcgacgcgaagugccagaccccgcagggcgccaucaacagcucccugcccuuccagaacgugcaccccgugaccaucggggagugccccaaguacguccgcagcaccaagcuccggauggugacgggccugcgcaacgugccguccauccagagccgggggcuguucggcgccaucgccggcuucaucgagggcggguggaccgggaugaucgacggcugguacggguaccaccaccagaacgagcagggcuccggcuacgccgcggaccagaaguccacccagaacgccaucaacgggaucaccaacaaggucaacagcaucaucgagaagaugaacacgcaguucaccgccgugggcaaggaguucaacaagcucgagcgccggauggagaaccugaacaagaagguggacgacggguuccuggacaucuggaccuacaacgccgagcuccugguccugcucgagaacgagcgcacccuggacuuccacgacagcaacgugaagaaccuguacgagaaggucaagacgcagcucaagaacaacgccaaggagaucggcaacgggugcuucgaguucuaccacaagugcaacaacgagugcauggaguccgugaagaacggcaccuacgacuaccccaaguacagcaaggaguccaagcugaaccgggagaagaucgacggcgugaagcuggagagcaugggggucuaccagauccucgcgaucuacagcaccguggccuccagccuggugcugcucgucucccugggcgccaucagcuucuggaugugcuccaacgggagccugcagugccgcaucugcaucuga

SEQ ID NO: 63127 - RNA, 1698 nt, Artificial Sequence
  derived and/or modified sequence opt1 from hemagglutinin__InfluenzaA__ABW81508
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucacccggaagaacgggcuguaccccaaccugagcaaguccuacgccaacaacaaggagaaggaggugcucguccuguggggcgugcaccacccgcccaacaucggggaccagcgcgcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggcgacaccaucaucuucgaggcgaacgggaaccugaucgccccgcgcuacgccuucgcccucucccggggcuucgggagcggcaucaucacguccaacgcccccauggacgagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggguucaucgagggcggcuggaccgggaugguggacggcugguacggguaccaccaccagaacgagcagggcuccggguacgcggccgaccagaaguccacccagaacgccaucaacggcaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcucaaccgggagaagaucgacggggugaagcuggaguccaugggcgucuaccagauccuggccaucuacagcacgguggccagcucccucgugcugcuggucagccucggcgccaucuccuucuggaugugcagcaacgggucccugcagugccgcaucugcaucuga

SEQ ID NO: 63128 - RNA, 1701 nt, Artificial Sequence; identical to SEQ ID NO: 63124
  derived and/or modified sequence opt1 from hemagglutinin__InfluenzaA__ABW81509

SEQ ID NO: 63129 - RNA, 1698 nt, Artificial Sequence
  derived and/or modified sequence opt1 from hemagglutinin__InfluenzaA__ABW81511
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacuccaucaucuucgaggcgaacgggaaccugaucgccccgugguacgccuucgcccucagccggggcuucggcuccgggaucaucaccagcaacgcccccauggacgagugcgacgcgaagugccagacgccccagggcgccaucaacuccagccugcccuuccagaacguccacccggugaccaucggggagugccccaaguacgugcgcuccgccaagcugcggauggucaccggccuccgcaacauccccagcauccagucccgggggcuguucggcgccaucgccggcuucaucgagggcggguggaccgggaugguggacggcugguacggguaccaccaccagaacgagcagggcagcggcuacgcggccgaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaaggucgacgacggguuccuggacaucuggacguacaacgccgagcugcucgugcugcuggagaacgagcgcacccucgacuuccacgacuccaacgugaagaaccuguacgagaaggucaagagccagcugaagaacaacgcgaaggagaucggcaacgggugcuucgaguucuaccacaagugcaacaacgagugcauggaguccgugaagaacggcaccuacgacuaccccaaguacagcgaggaguccaagcucaaccgggagaagaucgacggcgugaagcuggagagcaugggggucuaccagauccuggccaucuacagcaccguggccuccagccucgugcugcuggucucccucggcgccaucagcuucuggaugugcuccaacgggagccugcagugccgcaucugcaucuga

SEQ ID NO: 63130 - RNA, 1698 nt, Artificial Sequence; identical to SEQ ID NO: 61304
  derived and/or modified sequence opt1 from hemagglutinin__InfluenzaA__ABW81512

SEQ ID NO: 63131 - RNA, 1698 nt, Artificial Sequence; identical to SEQ ID NO: 62393
  derived and/or modified sequence opt1 from hemagglutinin__InfluenzaA__ABW81513

SEQ ID NO: 63132 - RNA, 1698 nt, Artificial Sequence
  derived and/or modified sequence opt1 from hemagglutinin__InfluenzaA__ABW81514
augaaggugaagcugcucguccugcugugcaccuucaccgccacguacgccgacaccaucugcaucagcuaccacgcgaacaacuccaccgacaccguggacacggugcucgagaagaacgucaccgugacccacagcgugaaccugcuggaggacucccacaacggcaagcucugccugcugaaggggaucgcgccccuccagcugggcaacugcagcgucgccggguggauccugggcaacccggagugcgagcuccugaucuccaaggagagcugguccuacaucguggagacccccaaccccgagaacgggacgugcuaccccggcuacuucgccgacuacgaggagcugcgcgagcagcucagcuccgugagcuccuucgagcgguucgagaucuucccgaaggagagcuccuggcccaaccacaccgucaccggcgugagcgccuccugcagccacaacgggaaguccagcuucuaccgcaaccugcuguggcucaccggcaagaacgggcuguaccccaaccuguccaagagcuacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggcgacaccaucaucuucgaggcgaacgggaaccugaucgccccgcgguucgccuucgcccucagccgcggcuucggguccggcaucaucacgagcaacgcccccauggacgagugcgacgcgaagugccagacgccccagggcgccaucaacuccagccugcccuuccagaacguccacccggugaccaucggggagugccccaaguacgugcgguccgccaagcugcgcauggccaccggccuccggaacauccccagcauccagucccgcgggcuguucggcgccaucgcgggguucaucgagggcggcuggaccgggauggucgacggcugguacggguaccaccaccagaacgagcagggcagcggguacgccgccgaccagaaguccacccagaacgccaucaacggcaucaccaacaaggugaacagcgugaucgagaagaugaacacccaguucacggccgucggcaaggaguucuccaagcuggagcggcgcauggagaaccucaacaagaagguggacgacggguuccuggacaucuggaccuacaacgcggagcugcucguccugcuggagaacgagcggacccucgacuuccacgacagcaacgugaagaaccuguacgagaaggugaagucccagcugaagaacaacgccaaggagaucggcaacgggugcuucgaguucuaccacaagugcaacgacgagugcauggagagcgucaagaacggcaccuacgacuaccccaaguacuccgaggagagcaagcucaaccgcgagaagaucgacggggugaagcuggagagcaugggcguguaccagauccuggccaucuacuccacggucgccagcucccucgugcugcuggugagccucggcgccaucuccuucuggaugugcagcaacgggucccugcagugccggaucugcaucuga

SEQ ID NO: 63133 - RNA, 1698 nt, Artificial Sequence; identical to SEQ ID NO: 62393
  derived and/or modified sequence opt1 from hemagglutinin__InfluenzaA__ABW81515

SEQ ID NO: 63134 - RNA, 1698 nt, Artificial Sequence; identical to SEQ ID NO: 62393
  derived and/or modified sequence opt1 from hemagglutinin__InfluenzaA__ABW81516

SEQ ID NO: 63135 - RNA, 1698 nt, Artificial Sequence
  derived and/or modified sequence opt1 from hemagglutinin__InfluenzaA__ABW81517
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcaucuccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcgccaagcugcgcauggccaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggucaacagcgugaucgagaagaugaacacccaguucacggccguggggaaggaguucagcaagcuggagcggcgcauggagaaccucaacaagaaggucgacgacggcuuccuggacaucuggaccuacaacgcggagcugcucgugcugcuggagaacgagcggacccucgacuuccacgacuccaacgucaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacgguggccuccagccucguccugcuggugucccucggggccaucagcuucuggaugugcuccaacggcagccugcagugccggaucugcaucuga

SEQ ID NO: 63136 - RNA, 1698 nt, Artificial Sequence
  derived and/or modified sequence opt1 from hemagglutinin__InfluenzaA__ABW81518
augaaggugaagcugcucguccugcugugcaccuacaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacggucgccuccagccucgugcugcuggugucccucggggccaucagcuucuggaugugcuccaacggcagccugcagugccggaucugcaucuga

SEQ ID NO: 63137 - RNA, 1698 nt, Artificial Sequence
  derived and/or modified sequence opt1 from hemagglutinin__InfluenzaA__ABW81519
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgcccacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacggucgccuccagccucgugcugcuggugucccucggggccaucagcuucuggaugugcuccaacggcagccugcagugccggaucugcaucuga

SEQ ID NO: 63138 - RNA, 1698 nt, Artificial Sequence
  derived and/or modified sequence opt1 from hemagglutinin__InfluenzaA__ABW81520
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcugggguccugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgcgagcagcucagcuccgugagcuccuucgagcgguucgagaucuucccgaaggagagcuccuggcccaaccacaccgucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggccaccgggcuccggaacauccccagcauccagucccgcggccuguucggggccaucgcgggcuucaucgagggcggguggaccggcauggucgacgggugguacggcuaccaccaccagaacgagcaggggagcggcuacgccgccgaccagaaguccacccagaacgccaucaacggcaucaccaacaaggugaacagcgugaucgagaagaugaacacccaguucacggccgucgggaaggaguucuccaagcuggagcggcgcauggagaaccucaacaagaagguggacgacggcuuccuggacaucuggaccuacaacgcggagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcucaaccgcgagaagaucgacggcgugaagcuggagagcaugggcguguaccagauccuggccaucuacuccacggucgccagcucccucgugcugcuggugagccucggggccaucuccuucuggaugugcagcaacggcucccugcagugccggaucugcaucuga

SEQ ID NO: 63139 - RNA, 1698 nt, Artificial Sequence
  derived and/or modified sequence opt1 from hemagglutinin__InfluenzaA__ABW81521
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucuccagcaacgcccccauggacgagugcgacgcgaagugccagacgccccagggggccaucaacuccagccugcccuuccagaacguccacccggugaccaucggcgagugccccaaguacgugcgguccgccaagcugcgcauggccaccgggcuccggaacauccccagcauccagucccgcggccuguucggggccaucgcgggcuucaucgagggcggguggaccggcauggucgacgggugguacggcuaccaccaccagaacgagcaggggagcggcuacgccgccgaccagaaguccacgcagaacgccaucaacggcaucaccaacaaggugaacagcgugaucgagaagaugaacacccaguucaccgccgucgggaaggaguucuccaagcuggagcggcgcauggagaaccucaacaagaagguggacgacggcuuccuggacaucuggacguacaacgcggagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcucaaccgcgagaagaucgacggcgugaagcuggagagcaugggcguguaccagauccuggccaucuacuccaccgucgccagcucccucgugcugcuggugagccucggggccaucuccuucuggaugugcagcaacggcucccugcagugccggaucugcaucuga

SEQ ID NO: 63140 - RNA, 1698 nt, Artificial Sequence; identical to SEQ ID NO: 62393
  derived and/or modified sequence opt1 from hemagglutinin__InfluenzaA__ABW81522

SEQ ID NO: 63141 - RNA, 1698 nt, Artificial Sequence; identical to SEQ ID NO: 62393
  derived and/or modified sequence opt1 from hemagglutinin__InfluenzaA__ABW81523

SEQ ID NO: 63142 - RNA, 1698 nt, Artificial Sequence
  derived and/or modified sequence opt1 from hemagglutinin__InfluenzaA__ABW81524
augaaggugaagcugcucguccugcugugcaccuucaccgccacguacgccgacaccaucugcaucggcuaccacgcgaacaacagcaccgacaccaucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcgccaagcugcgcauggccaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggucaacagcgugaucgagaagaugaacacccaguucacggccguggggaaggaguucagcaagcuggagcggcgcauggagaaccucaacaagaaggucgacgacggcuuccuggacaucuggaccuacaacgcggagcugcucgugcugcuggagaacgagcggacccucgacuuccacgacuccaacgucaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacgguggccuccagccucguccugcuggugucccucggggccaucagcuucuggaugugcuccaacggcagccugcagugccggaucugcaucuga

SEQ ID NO: 63143 - RNA, 1698 nt, Artificial Sequence
  derived and/or modified sequence opt1 from hemagglutinin__InfluenzaA__ABW81526
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccgcaaguucacgcccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggggaagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucacgaacaaggugaacagcgucaucgagaagaugaacacccaguucaccgccgugggcaaggaguucaacaagcuggagcgccggauggagaaccucaacaagaaggucgacgacggguucaucgacaucuggaccuacaacgccgagcugcuggugcuccuggagaacgagcgcacgcuggaccuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcucaaccgggagaagaucgacggcgugaagcuggaguccaugggggucuaccagauccuggccaucuacagcaccguggccagcucccucgugcugcuggucagccucggcgccaucuccuucuggaugugcagcaacgggucccugcagugccgcaucugcaucuga

SEQ ID NO: 63144 - RNA, 1698 nt, Artificial Sequence
  derived and/or modified sequence opt1 from hemagglutinin__InfluenzaA__ABW81527
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcggaaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacggucgccuccagccucgugcugcuggugucccucggggccaucagcuucuggaugugcuccaacggcagccugcagugccggaucugcaucuga

SEQ ID NO: 63145 - RNA, 1698 nt, Artificial Sequence
  derived and/or modified sequence opt1 from hemagglutinin__InfluenzaA__ABW81528
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggccacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccugugggggauccaccacccgcccaacaucggcgaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagccccgggacaccaucaucuucgaggcgaacgggaaccugaucgccccgcgcuucgccuucgcccucucccggggcuucgggagcggcaucaucacguccaacgcccccauggacgagugcgacgcgaagugccagacgccccagggcgccaucaacagcucccugcccuuccagaacgugcacccggucaccaucggggagugccccaaguacgugcgcagcgccaagcugcggauggugaccggccuccgcaacauccccuccauccagagccgggggcuguucggcgccaucgccggguucaucgagggcggcuggaccgggauggucgacggcugguacggguaccaccaccagaacgagcagggcuccggguacgcggccgaccagaaguccacccagaacgccaucaacggcaucaccaacaaggugaacagcgugaucgagaagaugaacacccaguucacggccgucggcaaggaguucaacaagcuggagcgccggauggagaaccucaacaagaagguggacgacggguuccuggacaucuggaccuacaacgccgagcugcucguccugcuggagaacgagcgcacccucgacuuccacgacagcaacgugaagaaccuguacgagaaggugaagucccagcugaagaacaacgcgaaggagaucggcaacgggugcuucgaguucuaccacaagugcaacgacgagugcauggagagcgucaagaacggcaccuacgacuaccccaaguacuccgaggagagcaagcucaaccgggagaagaucgacggggugaagcuggaguccaugggcguguaccagauccuggccaucuacagcacggucgccagcucccucgugcugcuggugagccucggcgccaucuccuucuggaugugcagcaacgggucccugcagugccgcaucugcaucuga

SEQ ID NO: 63146 - RNA, 1698 nt, Artificial Sequence
  derived and/or modified sequence opt1 from hemagglutinin__InfluenzaA__ABW81529
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagccgcgaguccuggagcuacaucgucgagacccccaaccccgagaacggcacgugcuaccccggcuacuucgccgacuacgaggagcugcgggagcagcucuccagcguguccagcuucgagcgcuucgagaucuucccgaaggaguccagcuggcccaaccacaccgugaccggggucuccgccagcugcucccacaacggcaagagcuccuucuaccggaaccugcuguggcucaccgggaagaacggccuguaccccaaccugagcaaguccuacgccaacaacaaggagaaggaggugcucauccuguggggcgugcaccacccgcccaacauccgcgaccagaugacgcuguaccacaccgagaacgccuacgucagcguggugagcucccacuacagccggcgcuucacccccgagaucaccaagcggcccaagguccgcgaccaggaggggcggaucaacuacuacuggacgcuccuggagcccggcgacaccaucaucuucgaggccaacgggaaccugaucgccccgugguacgcguucgcccucucccgcggcuucgggagcggcaucaucaccuccaacgcccccauggacgagugcgacgccaagugccagacccccaagggcgccaucaacagcucccugcccuuccagaacgugcacccggugacgaucggggagugccccaaguacguccggagcgcgaagcugcgcauggugaccggccuccggaacauccccuccauccagagccgcgggcuguucggcgccaucgccggguucaucgagggcggcuggaccgggaugguggacggcugguacggguaccaccaccagaacgagcagggcuccggguacgccgccgaccagaaguccacccagaacgcgaucaacggcaucacgaacaaggucaacagcgugaucgagaagaugaacacccaguucaccgccgugggcaaggaguucaacaagcuggagcggcgcauggagaaccucaacaagaaggucgacgacggguuccuggacaucuggaccuacaacgccgagcugcucgugcugcuggagaacgagcggacgcucgacuuccacgacagcaacgucaagaaccuguacgagaaggugaagucccagcugaagaacaacgccaaggagaucggcaacgggugcuucgaguucuaccacaagugcaacaacgagugcauggagagcgugaagaacggcaccuacgacuaccccaaguacuccgaggagagcaagcucaaccgcgagaagaucgacggggucaagcuggaguccaugggcguguaccagauccuggccaucuacagcaccguggcgagcucccucguccugcuggugagccucggcgccaucuccuucuggaugugcagcaacgggucccugcagugccggaucugcaucuga

SEQ ID NO: 63147 - RNA, 1698 nt, Artificial Sequence
  derived and/or modified sequence opt1 from hemagglutinin__InfluenzaA__ABW81530
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucagcguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaaccgcaucaccaacaaggucaacagcgugaucgagaagaugaacacgcaguucaccgccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgucaagaaccuguacgagaaggugaagucccagcugaagaacaacgccaaggagaucggcaacgggugcuucgaguucuaccacaagugcaacaacgagugcauggagagcgugaagaacggcacguacgacuaccccaaguacuccgaggagagcaagcucaaccgcgagaagaucgacggggucaagcuggacuccaugggcguguaccagauccuggcgaucuacagcaccguggccagcucccucguccugcuggugagccucggcgccaucuccuucuggaugugcagcaacgggucccugcagugccggaucugcaucuga

SEQ ID NO: 63148 - RNA, 1698 nt, Artificial Sequence; identical to SEQ ID NO: 61334
  derived and/or modified sequence opt1 from hemagglutinin__InfluenzaA__ABW81531

SEQ ID NO: 63149 - RNA, 1698 nt, Artificial Sequence
  derived and/or modified sequence opt1 from hemagglutinin__InfluenzaA__ABW81532
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccugguacuucgccgacuacgaggagcugcgcgagcagcucuccagcguguccagcuucgagcgguucgagaucuucccgaaggaguccagcuggcccaaccacacggugaccggcgucuccgccagcugcucccacaacggcaagagcuccuucuaccgcaaccugcuguggcucaccgggaagaacgggcuguaccccaaccugagcaaguccuacgccaacaacaaggagaaggaggugcucauccuguggggcgugcaccacccgcccaacaucgggaaccagcggacccuguaccacacggagaacgccuacgucagcguggugagcucccacuacagccgccgguucacccccgagaucaccaagcgccccaagguccgggaccaggagggccgcaucaacuacuacuggacccuccuggagcccggcgacacgaucaucuucgaggccaacgggaaccugaucgcgccgugguacgccuucgcccucucccggggcuucgggagcggcaucaucaccuccaacgcccccauggacgagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacccagaacgccaucaacggcaucaccaacaaggucaacagcgugaucgagaagaugaacacgcaguucaccgccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucggcaacgggugcuucgaguucuaccacaagugcaacaacgagugcauggagagcgugaagaacggcacguacgacuaccccaaguacuccgaggagagcaagcucaaccgggagaagaucgacggggucaagcuggacuccaugggcguguaccagauccuggcgaucuacagcaccguggccagcucccucguccugcuggugagccucggcgccaucuccuucuggaugugcagcaacgggucccugcagugccgcaucugcaucuga

SEQ ID NO: 63150 - RNA, 1698 nt, Artificial Sequence; identical to SEQ ID NO: 62964
  derived and/or modified sequence opt1 from hemagglutinin__InfluenzaA__ABW86321

SEQ ID NO: 63151 - RNA, 1698 nt, Artificial Sequence; identical to SEQ ID NO: 62929
  derived and/or modified sequence opt1 from hemagglutinin__InfluenzaA__ABW86332

SEQ ID NO: 63152 - RNA, 1698 nt, Artificial Sequence; identical to SEQ ID NO: 62918
  derived and/or modified sequence opt1 from hemagglutinin__InfluenzaA__ABW86343

SEQ ID NO: 63153 - RNA, 1698 nt, Artificial Sequence; identical to SEQ ID NO: 62922
  derived and/or modified sequence opt1 from hemagglutinin__InfluenzaA__ABW86354

SEQ ID NO: 63154 - RNA, 1698 nt, Artificial Sequence; identical to SEQ ID NO: 62922
  derived and/or modified sequence opt1 from hemagglutinin__InfluenzaA__ABW86365

SEQ ID NO: 63155 - RNA, 1698 nt, Artificial Sequence; identical to SEQ ID NO: 62938
  derived and/or modified sequence opt1 from hemagglutinin__InfluenzaA__ABW86376

SEQ ID NO: 63156 - RNA, 1698 nt, Artificial Sequence; identical to SEQ ID NO: 62922
  derived and/or modified sequence opt1 from hemagglutinin__InfluenzaA__ABW86387

SEQ ID NO: 63157 - RNA, 1698 nt, Artificial Sequence; identical to SEQ ID NO: 62918
  derived and/or modified sequence opt1 from hemagglutinin__InfluenzaA__ABW86409

SEQ ID NO: 63158 - RNA, 1698 nt, Artificial Sequence; identical to SEQ ID NO: 62918
  derived and/or modified sequence opt1 from hemagglutinin__InfluenzaA__ABW86431

SEQ ID NO: 63159 - RNA, 1698 nt, Artificial Sequence; identical to SEQ ID NO: 62922
  derived and/or modified sequence opt1 from hemagglutinin__InfluenzaA__ABW86442

SEQ ID NO: 63160 - RNA, 1698 nt, Artificial Sequence; identical to SEQ ID NO: 62938
  derived and/or modified sequence opt1 from hemagglutinin__InfluenzaA__ABW86453

SEQ ID NO: 63161 - RNA, 1698 nt, Artificial Sequence; identical to SEQ ID NO: 62922
  derived and/or modified sequence opt1 from hemagglutinin__InfluenzaA__ABW86464

SEQ ID NO: 63162 - RNA, 1698 nt, Artificial Sequence; identical to SEQ ID NO: 62938
  derived and/or modified sequence opt1 from hemagglutinin__InfluenzaA__ABW86475

SEQ ID NO: 63163 - RNA, 1698 nt, Artificial Sequence; identical to SEQ ID NO: 62918
  derived and/or modified sequence opt1 from hemagglutinin__InfluenzaA__ABW86486

SEQ ID NO: 63164 - RNA, 1698 nt, Artificial Sequence; identical to SEQ ID NO: 62964
  derived and/or modified sequence opt1 from hemagglutinin__InfluenzaA__ABW86497

SEQ ID NO: 63165 - RNA, 1698 nt, Artificial Sequence; identical to SEQ ID NO: 62922
  derived and/or modified sequence opt1 from hemagglutinin__InfluenzaA__ABW86508

SEQ ID NO: 63166 - RNA, 1698 nt, Artificial Sequence
  derived and/or modified sequence opt1 from hemagglutinin__InfluenzaA__ABW86519
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcggaaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccaugggggagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 63167 - RNA, 1698 nt, Artificial Sequence; identical to SEQ ID NO: 62918
  derived and/or modified sequence opt1 from hemagglutinin__InfluenzaA__ABW86530

SEQ ID NO: 63168 - RNA, 1698 nt, Artificial Sequence
  derived and/or modified sequence opt1 from hemagglutinin__InfluenzaA__ABW86541
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcugaaccacaccgucaccgggguguccgccagcugcucccacaacggcaagagcuccuucuaccgcaaccugcucuggcugaccgggaagaacggccuguaccccaaccucagcaaguccuacgccaacaacaaggagaaggaggugcugguccuguggggcgugcaccacccgcccaacaucggggaccagcgggcccucuaccacacggagaacgccuacgugagcgucgugagcucccacuacagccgccgguucacccccgagaucgccaagcgccccaaggugcgggaccaggagggccgcaucaacuacuacuggacccugcuggagcccggggacaccaucaucuucgaggcgaacggcaaccucaucgcgccccgguucgccuucgcccugucccgcggguucggcagcggcaucaucacguccaacgccccgaugggggagugcgacgccaagugccagacgccccagggcgccaucaacagcucccugcccuuccagaacguccaccccgugaccaucggggagugcccgaaguacgugcggagcgccaagcuccgcauggucaccggccugcggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcucgagcggcgcauggagaaccugaacaagaaggucgacgacggguuccuggacaucuggaccuacaacgccgagcuccuggugcugcucgagaacgagcggacccuggacuuccacgacagcaacgugaagaaccuguacgagaaggucaagucccagcucaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgugaagcuggaguccaugggggucuaccagauccucgccaucuacagcacgguggccagcucccuggugcugcucgucagccugggcgccaucuccuucuggaugugcagcaacgggucccugcagugccggaucugcaucuga

SEQ ID NO: 63169 - RNA, 1698 nt, Artificial Sequence; identical to SEQ ID NO: 62918
  derived and/or modified sequence opt1 from hemagglutinin__InfluenzaA__ABW86552

SEQ ID NO: 63170 - RNA, 1701 nt, Artificial Sequence
  derived and/or modified sequence opt1 from hemagglutinin__InfluenzaA__ABW86563
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggccacaaggacuggauccuguggaucuccuucgccaucagcugcuuccuccugugcguggcccugcucggcuucaucaugugggccugccagaaggggaacauccgcugcaacaucugcaucuga

SEQ ID NO: 63171 - RNA, 1698 nt, Artificial Sequence; identical to SEQ ID NO: 62955
  derived and/or modified sequence opt1 from hemagglutinin__InfluenzaA__ABW86606

SEQ ID NO: 63172 - RNA, 1701 nt, Artificial Sequence; identical to SEQ ID NO: 61929
  derived and/or modified sequence opt1 from hemagglutinin__InfluenzaA__ABW91185

SEQ ID NO: 63173 - RNA, 1701 nt, Artificial Sequence
  derived and/or modified sequence opt1 from hemagglutinin__InfluenzaA__ABW91196
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcaacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 63174 - RNA, 1701 nt, Artificial Sequence; identical to SEQ ID NO: 63173
  derived and/or modified sequence opt1 from hemagglutinin__InfluenzaA__ABW91207

SEQ ID NO: 63175 - RNA, 1698 nt, Artificial Sequence; identical to SEQ ID NO: 62918
  derived and/or modified sequence opt1 from hemagglutinin__InfluenzaA__ABW91218

SEQ ID NO: 63176 - RNA, 1701 nt, Artificial Sequence; identical to SEQ ID NO: 62936
  derived and/or modified sequence opt1 from hemagglutinin__InfluenzaA__ABW91240

SEQ ID NO: 63177 - RNA, 1701 nt, Artificial Sequence
  derived and/or modified sequence opt1 from hemagglutinin__InfluenzaA__ABW91251
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaaguccggcgacauccugcucaucaacagcaccgggaaccugaucgcgccccggggcuacuucaagauccgcuccgggaaguccuccaucaugcggagcgacgccccgaucggcaagugcaacuccgagugcaucacgcccaacggcagcauccccaacgacaagcccuuccagaacgugaaccgcaucaccuacggggccugcccgcgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 63178 - RNA, 1701 nt, Artificial Sequence; identical to SEQ ID NO: 62936
  derived and/or modified sequence opt1 from hemagglutinin__InfluenzaA__ABW91262

SEQ ID NO: 63179 - RNA, 1698 nt, Artificial Sequence; identical to SEQ ID NO: 62953
  derived and/or modified sequence opt1 from hemagglutinin__InfluenzaA__ABW91273

SEQ ID NO: 63180 - RNA, 1698 nt, Artificial Sequence
  derived and/or modified sequence opt1 from hemagglutinin__InfluenzaA__ABW91284
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacgaccaccggggucuccgccagcugcucccacaacggcgagagcuccuucuacaagaaccugcuguggcucaccgggaagaacggccuguaccccaaccugagcaaguccuacgccaacaacaaggagaaggaggugcucgugcuguggggcguccaccacccgcccaacaucggcgaccagcgggcccuguaccacacggagaacgccuacgugagcguggucagcucccacuacagccgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgccagcaugggggagugcgacgcgaagugccagacgccccagggcgccaucaacuccagccugcccuuccagaacgugcaccccgucaccaucggggagugcccgaaguacgugcgcuccgccaagcugcggauggugaccggccuccgcaacauccccagcauccagucccgggggcuguucggcgccaucgccggcuucaucgagggcggguggaccgggauggucgacggcugguacggguaccaccaccagaacgagcagggcagcggcuacgcggccgaccagaaguccacgcagaacgccaucaacgggaucaccaacaaggugaacagcgugaucgagaagaugaacacccaguucaccgccgucggcaaggaguucaacaagcuggagcgccggauggagaaccucaacaagaagguggacgacggguucaucgacaucuggacguacaacgccgagcugcugguccuccuggagaacgagcgcacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgggagaagaucgacggcgugaagcucgagagcauggggguguaccagauccuggccaucuacagcaccgucgccuccagccuggugcuccuggugucccugggcgccaucagcuucuggaugugcuccaacgggagccuccagugccgcaucugcaucuga

SEQ ID NO: 63181 - RNA, 1698 nt, Artificial Sequence; identical to SEQ ID NO: 62953
  derived and/or modified sequence opt1 from hemagglutinin__InfluenzaA__ABW91295

SEQ ID NO: 63182 - RNA, 1698 nt, Artificial Sequence; identical to SEQ ID NO: 62922
  derived and/or modified sequence opt1 from hemagglutinin__InfluenzaA__ABW91306

SEQ ID NO: 63183 - RNA, 1698 nt, Artificial Sequence; identical to SEQ ID NO: 62922
  derived and/or modified sequence opt1 from hemagglutinin__InfluenzaA__ABW91317

SEQ ID NO: 63184 - RNA, 1698 nt, Artificial Sequence
  derived and/or modified sequence opt1 from hemagglutinin__InfluenzaA__ABW91328
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugcgcucccagcugaagaacaacgccaaggagaucgggaacggcugcuucgaguucuaccacaagugcaacgacgagugcauggagagcgucaagaacgggacguacgacuaccccaaguacuccgaggagagcaagcucaaccgggagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccgcaucugcaucuga

SEQ ID NO: 63185 - RNA, 1698 nt, Artificial Sequence; identical to SEQ ID NO: 62922
  derived and/or modified sequence opt1 from hemagglutinin__InfluenzaA__ABW91339

SEQ ID NO: 63186 - RNA, 1698 nt, Artificial Sequence; identical to SEQ ID NO: 62922
  derived and/or modified sequence opt1 from hemagglutinin__InfluenzaA__ABW91350

SEQ ID NO: 63187 - RNA, 1698 nt, Artificial Sequence
  derived and/or modified sequence opt1 from hemagglutinin__InfluenzaA__ABW91361
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacaagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagacccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuuccuggacaucuggaccuacaacgccgagcugcucgugcugcuggagaacgagcggacgcucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcgucuaccagauccuggcgaucuacuccaccguggccagcagccucgugcugcuggucucccucggggccaucagcuucuggaugugcuccaacggcagccugcagugccggaucugcaucuga

SEQ ID NO: 63188 - RNA, 1698 nt, Artificial Sequence; identical to SEQ ID NO: 62922
  derived and/or modified sequence opt1 from hemagglutinin__InfluenzaA__ABW91372

SEQ ID NO: 63189 - RNA, 1698 nt, Artificial Sequence; identical to SEQ ID NO: 62955
  derived and/or modified sequence opt1 from hemagglutinin__InfluenzaA__ABW91383

SEQ ID NO: 63190 - RNA, 1701 nt, Artificial Sequence; identical to SEQ ID NO: 62995
  derived and/or modified sequence opt1 from hemagglutinin__InfluenzaA__ABW91394

SEQ ID NO: 63191 - RNA, 1698 nt, Artificial Sequence; identical to SEQ ID NO: 62964
  derived and/or modified sequence opt1 from hemagglutinin__InfluenzaA__ABW91405

SEQ ID NO: 63192 - RNA, 1698 nt, Artificial Sequence
  derived and/or modified sequence opt1 from hemagglutinin__InfluenzaA__ABW91416
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagaaggcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccaugggggagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcgccggauggagaaccucaacaagaaggucgacgacggguuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcucaaccgggagaagaucgacggcgugaagcuggaguccaugggggucuaccagauccuggccaucuacagcacgguggccagcucccucgugcugcuggucagccucggcgccaucuccuucuggaugugcagcaacgggucccugcagugccgcaucugcaucuga

SEQ ID NO: 63193 - RNA, 1698 nt, Artificial Sequence; identical to SEQ ID NO: 63067
  derived and/or modified sequence opt1 from hemagglutinin__InfluenzaA__ABW91427

SEQ ID NO: 63194 - RNA, 1701 nt, Artificial Sequence; identical to SEQ ID NO: 62936
  derived and/or modified sequence opt1 from hemagglutinin__InfluenzaA__ABW91438

SEQ ID NO: 63195 - RNA, 1698 nt, Artificial Sequence; identical to SEQ ID NO: 62964
  derived and/or modified sequence opt1 from hemagglutinin__InfluenzaA__ABW91449

SEQ ID NO: 63196 - RNA, 1698 nt, Artificial Sequence; identical to SEQ ID NO: 62964
  derived and/or modified sequence opt1 from hemagglutinin__InfluenzaA__ABW91460

SEQ ID NO: 63197 - RNA, 1698 nt, Artificial Sequence
  derived and/or modified sequence opt1 from hemagglutinin__InfluenzaA__ABW91471
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcgucgcgccccuccagcuggggaacugcuccguggccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcgucuccagcuucgagcgguucgagaucuucccgaaggaguccagcuggcccaaccacaccgugaccgggguguccgccagcugcucccacaacggcaagagcuccuucuaccgcaaccugcuguggcucaccgggaagaacggccuguaccccaaccugagcaaguccuacgccaacaacaaggagaaggagguccucgugcuguggggcgugcaccacccgcccaacaucggggaccagcgggcccuguaccacacggagaacgccuacgucagcguggugagcucccacuacagccgccgguucacccccgagaucgccaagcgccccaagguccgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggugaccaucggcgagugccccaaguacguccggagcaccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgcgagaagaucgacggcgucaagcuggaguccaugggcguguaccagauccuggcgaucuacagcaccguggccagcucccucguccugcuggugagccucggggccaucuccuucuggaugugcagcaacggcucccugcagugccggaucugcaucuga

SEQ ID NO: 63198 - RNA, 1698 nt, Artificial Sequence
  derived and/or modified sequence opt1 from hemagglutinin__InfluenzaA__ABW91482
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugagcuccuucgagcgcuucgagaucuucccgaaggagagcuccuggcccaaccacaccgucaccggggugagcgccuccugcagccacaacggccgguccagcuucuaccgcaaccugcuguggcucaccgggaagaacggccuguaccccaaccugucccggagcuacgccaacaacaaggagaaggaggugcucguccuguggggcgugcaccacccgcccaacaucggggaccagcgcgcccuguaccacacggagaacgccuacguguccgucgugagcagccacuacucccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucagccggggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagagcaugggcgucuaccagauccuggccaucuacuccacgguggccagcagccucgugcugcuggucucccucggggccaucagcuucuggaugugcuccaacggcagccugcagugccgcaucugcaucuga

SEQ ID NO: 63199 - RNA, 1698 nt, Artificial Sequence
  derived and/or modified sequence opt1 from hemagglutinin__InfluenzaA__ABW91493
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagaagcggauggagaaccucaacaagaagguggacgacggcuuccuggacaucuggaccuacaacgccgagcugcucguccugcuggagaacgagcgcacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagagcaagcucaaccgggagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccgcaucugcaucuga

SEQ ID NO: 63200 - RNA, 1698 nt, Artificial Sequence; identical to SEQ ID NO: 62938
  derived and/or modified sequence opt1 from hemagglutinin__InfluenzaA__ABW91504

SEQ ID NO: 63201 - RNA, 1698 nt, Artificial Sequence
  derived and/or modified sequence opt1 from hemagglutinin__InfluenzaA__ABW91515
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacgugguggagacccccaaccccgagaacggcacgugcuaccccggcuacuucgccgacuacgaggagcugcgggagcagcucagcuccgucagcuccuucgagcgcuucgagaucuucccgaaggagagcuccuggcccaaccacaccgugaccggggugagcgccuccugcagccacaacggcaaguccagcuucuaccggaaccugcuguggcucaccgggaagaacggccuguaccccaaccuguccaagagcuacgccaacaacaaggagaaggagguccucgugcuguggggcgugcaccacccgcccaacaucggggaccagcgcgcccuguaccacacggagaacgccuacgucuccguggugagcagccacuacucccggcgcuucacccccgagaucgccaagcggcccaagguccgcgaccaggagggccggaucaacuacuacuggacccuccuggagcccggggacaccaucaucuucgaggcgaacggcaaccugaucgccccgcgcuucgccuucgcccucagccggggguucggcuccggcaucaucacgagcaacgcccccauggacgagugcgacgcgaagugccagacgccccagggggccaucaacuccagccugcccuuccagaacgugcacccggugaccaucggcgagugccccaaguacguccgcuccgccaagcugcggauggugaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggucaacagcgugaucgagaagaugaacacccaguucacggccgucgggaaggaguucaacaagcuggagcgccggauggagaaccucaacaagaagguggacgacggcuuccuggacaucuggaccuacaacgccgagcugcucgugcugcuggagaacgagcgcacccucgacuuccacgacuccaacgucaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagagcaugggcguguaccagauccuggccaucuacuccacgguggccagcagccucguccugcuggugucccucggggccaucagcuucuggaugugcuccaacggcagccugcagugccgcaucugcaucuga

SEQ ID NO: 63202 - RNA, 1698 nt, Artificial Sequence
  derived and/or modified sequence opt1 from hemagglutinin__InfluenzaA__ABW91526
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggagcaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcacccgccugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 63203 - RNA, 1698 nt, Artificial Sequence; identical to SEQ ID NO: 62922
  derived and/or modified sequence opt1 from hemagglutinin__InfluenzaA__ABW91537

SEQ ID NO: 63204 - RNA, 1701 nt, Artificial Sequence; identical to SEQ ID NO: 62995
  derived and/or modified sequence opt1 from hemagglutinin__InfluenzaA__ABW91548

SEQ ID NO: 63205 - RNA, 1698 nt, Artificial Sequence
  derived and/or modified sequence opt1 from hemagglutinin__InfluenzaA__ABW91559
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagagcaagcucuaccgcgagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccggaucugcaucuga

SEQ ID NO: 63206 - RNA, 1698 nt, Artificial Sequence; identical to SEQ ID NO: 63063
  derived and/or modified sequence opt1 from hemagglutinin__InfluenzaA__ABW91570

SEQ ID NO: 63207 - RNA, 1698 nt, Artificial Sequence; identical to SEQ ID NO: 62938
  derived and/or modified sequence opt1 from hemagglutinin__InfluenzaA__ABW91581

SEQ ID NO: 63208 - RNA, 1698 nt, Artificial Sequence; identical to SEQ ID NO: 62918
  derived and/or modified sequence opt1 from hemagglutinin__InfluenzaA__ABW91592

SEQ ID NO: 63209 - RNA, 1698 nt, Artificial Sequence; identical to SEQ ID NO: 62964
  derived and/or modified sequence opt1 from hemagglutinin__InfluenzaA__ABW91603

SEQ ID NO: 63210 - RNA, 1698 nt, Artificial Sequence
  derived and/or modified sequence opt1 from hemagglutinin__InfluenzaA__ABW91614
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccucccccgagaacggcacgugcuaccccggcuacuucgccgacuacgaggagcugcgcgagcagcucagcuccgugagcuccuucgagcgguucgagaucuucccgaaggagagcuccuggcccaaccacaccgucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucagcuccaacgcccccaugggggagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggguuccuggacaucuggacguacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcucaaccgcgagaagaucgacggcgugaagcuggagagcaugggggucuaccagauccuggccaucuacuccaccguggccagcucccucgugcugcuggucagccucggcgccaucuccuucuggaugugcagcaacgggucccugcagugccggaucugcaucuga

SEQ ID NO: 63211 - RNA, 1698 nt, Artificial Sequence; identical to SEQ ID NO: 62953
  derived and/or modified sequence opt1 from hemagglutinin__InfluenzaA__ABW91625

SEQ ID NO: 63212 - RNA, 1698 nt, Artificial Sequence; identical to SEQ ID NO: 62922
  derived and/or modified sequence opt1 from hemagglutinin__InfluenzaA__ABW91636

SEQ ID NO: 63213 - RNA, 1701 nt, Artificial Sequence; identical to SEQ ID NO: 62995
  derived and/or modified sequence opt1 from hemagglutinin__InfluenzaA__ABW91647

SEQ ID NO: 63214 - RNA, 1707 nt, Artificial Sequence
  derived and/or modified sequence opt1 from hemagglutinin__InfluenzaA__ABX10515
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgucaacgaccucugcuaccccggggacuucaacgacuacgaggagcugaagcaccuccucucccggaucaaccacuucgagaagauccagaucauccccaagagcuccuggagcucccacgaggugagccugggcguguccagcgccugcccguaccagggcaaguccagcuucuuccgcaacgucguguggcugaucaagaagaacuccaccuaccccacgaucaagcggagcuacaacaacaccaaccaggaggaccuccuggugcugugggggauccaccaccccaacgacgccgcggagcagaccaagcucuaccagaacccgaccacguacaucuccgucggcaccagcacccugaaccagcgccuggugccccggaucgccacccgcuccaaggugaacgggcagagcggccggauggaguucuucuggacgauccucaagcccaacgacgccaucaacuucgagagcaacgggaacuucaucgcccccgaguacgcguacaagaucgucaagaagggcgacuccaccaucaugaaguccgagcuggaguacggcaacugcaacaccaagugccagaccccgaugggggccaucaacagcagcaugcccuuccacaacauccacccccugacgaucggcgagugccccaaguacgugaaguccaaccgccucgugcuggccaccgggcugcggaacagcccgcagcgcgagcggcgccggaagaagcgcggccucuucggcgccaucgccggguucaucgagggcggguggcagggcauggucgacgggugguacggcuaccaccacuccaacgagcagggcagcggguacgcggccgacaaggaguccacccagaaggccaucgacggcgugaccaacaaggugaacagcaucaucgacaagaugaacacgcaguucgaggccgucgggcgggaguucaacaaccuggagcgccggaucgagaaccugaacaagaagauggaggacggcuuccucgacguguggaccuacaacgccgagcugcugguccucauggagaacgagcgcacccuggacuuccacgacuccaacgugaagaaccuguacgacaaggugcggcuccagcugaaggacaacgcgaaggagcuggggaacggcugcuucgaguucuaccacaagugcgacaacgagugcauggagagcguccgcaacggcaccuacgacuacccccaguacuccgaggaggcccggcucaagcgcgaggagaucagcggggugaagcuggaguccaucggcaucuaccagauccugagcaucuacuccacgguggccagcucccucgcccuggccaucauggucgcggggcugagccucuggaugugcagcaacggcucccugcagugccgcaucugcaucuga

SEQ ID NO: 63215 - RNA, 1701 nt, Artificial Sequence; identical to SEQ ID NO: 62864
  derived and/or modified sequence opt1 from hemagglutinin__InfluenzaA__ABX10525

SEQ ID NO: 63216 - RNA, 1698 nt, Artificial Sequence; identical to SEQ ID NO: 62922
  derived and/or modified sequence opt1 from hemagglutinin__InfluenzaA__ABX58239

SEQ ID NO: 63217 - RNA, 1698 nt, Artificial Sequence; identical to SEQ ID NO: 63022
  derived and/or modified sequence opt1 from hemagglutinin__InfluenzaA__ABX58250

SEQ ID NO: 63218 - RNA, 1698 nt, Artificial Sequence
  derived and/or modified sequence opt1 from hemagglutinin__InfluenzaA__ABX58261
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggucccuccuggagcccggggacaccaucaucuucgaggcgaacggcaaccugaucgccccgcgguucgccuucgcccucagccgcggguucggcuccggcaucaucaccagcaacgcccccauggacgagugcgacgcgaagugccagacgccccagggggccaucaacuccagccugcccuuccagaacgugcacccggucaccaucggcgagugccccaaguacgugcgguccaccaagcugcgcauggugaccgggcuccggaacauccccagcauccagucccgcggccuguucggggccaucgccggcuucaucgagggcggguggacgggcauggucgacgggugguacggcuaccaccaccagaacgagcaggggagcggcuacgccgcggaccagaaguccacccagaacgccaucaacggcaucaccaacaaggugaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggcgaucuacagcacggucgccuccagccucgugcugcuggugucccucggggccaucagcuucuggaugugcuccaacggcagccugcagugccggaucugcaucuga

SEQ ID NO: 63219 - RNA, 1698 nt, Artificial Sequence
  derived and/or modified sequence opt1 from hemagglutinin__InfluenzaA__ABX58272
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagaaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagagcaagcucaaccgcgagaagaucgacggcgugaagcuggaguccaugggcguguaccagauccuggcgaucuacagcaccgucgccagcucccucgugcugcuggugagccucggggccaucuccuucuggaugugcagcaacggcucccugcagugccggaucugcaucuga

SEQ ID NO: 63220 - RNA, 1698 nt, Artificial Sequence; identical to SEQ ID NO: 62922
  derived and/or modified sequence opt1 from hemagglutinin__InfluenzaA__ABX58283

SEQ ID NO: 63221 - RNA, 1698 nt, Artificial Sequence; identical to SEQ ID NO: 63063
  derived and/or modified sequence opt1 from hemagglutinin__InfluenzaA__ABX58294

SEQ ID NO: 63222 - RNA, 1698 nt, Artificial Sequence; identical to SEQ ID NO: 62918
  derived and/or modified sequence opt1 from hemagglutinin__InfluenzaA__ABX58316

SEQ ID NO: 63223 - RNA, 1698 nt, Artificial Sequence; identical to SEQ ID NO: 63067
  derived and/or modified sequence opt1 from hemagglutinin__InfluenzaA__ABX58327

SEQ ID NO: 63224 - RNA, 1698 nt, Artificial Sequence; identical to SEQ ID NO: 62918
  derived and/or modified sequence opt1 from hemagglutinin__InfluenzaA__ABX58338

SEQ ID NO: 63225 - RNA, 1698 nt, Artificial Sequence
  derived and/or modified sequence opt1 from hemagglutinin__InfluenzaA__ABX58360
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcccccauccagcucgggaacugcuccgucgccggcuggauccuggggaacccggagugcgagcugcucaucagcaaggaguccuggagcuacaucguggagacccccaaccccgagaacggcacgugcuaccccggcuacuucgccgacuacgaggagcugcgcgagcagcuguccagcguguccagcuucgagcgguucgagaucuucccgaaggaguccagcuggcccaaccacaccgucaccgggguguccgccagcugcucccacaacggcaagagcuccuucuaccgcaaccuccuguggcugaccgggaagaacggccucuaccccaaccugagcaaguccuacgcgaacaacaaggagaaggaggugcugguccucuggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccugcucgagcccggggacaccaucaucuucgaggcgaacggcaaccugaucgccccgcgguucgccuucgcccugucccgcggguucggcagcggcaucaucacguccaacgcccccauggacgagugcgacgcgaagugccagacgccccagggggccaucaacagcucccuccccuuccagaacguccacccggugaccaucggcgagugccccaaguacgugcggagcaccaagcugcgcauggucaccgggcugcggaacauccccuccauccagagccgcggccucuucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccugaacaagaaggucgacgacggcuuccucgacaucuggaccuacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgggugcauggagagcgugaagaacggcacguacgacuaccccaaguacuccgaggagagcaagcugaaccgcgagaagaucgacggcgugaagcucgaguccaugggggucuaccagauccuggcgaucuacagcaccguggccagcucccuggugcuccuggucagccugggcgccaucuccuucuggaugugcagcaacgggucccuccagugccggaucugcaucuga

SEQ ID NO: 63226 - RNA, 1698 nt, Artificial Sequence; identical to SEQ ID NO: 62922
  derived and/or modified sequence opt1 from hemagglutinin__InfluenzaA__ABX58371

SEQ ID NO: 63227 - RNA, 1698 nt, Artificial Sequence; identical to SEQ ID NO: 62922
  derived and/or modified sequence opt1 from hemagglutinin__InfluenzaA__ABX58382

SEQ ID NO: 63228 - RNA, 1698 nt, Artificial Sequence; identical to SEQ ID NO: 63063
  derived and/or modified sequence opt1 from hemagglutinin__InfluenzaA__ABX58393

SEQ ID NO: 63229 - RNA, 1698 nt, Artificial Sequence; identical to SEQ ID NO: 62922
  derived and/or modified sequence opt1 from hemagglutinin__InfluenzaA__ABX58404

SEQ ID NO: 63230 - RNA, 1698 nt, Artificial Sequence
  derived and/or modified sequence opt1 from hemagglutinin__InfluenzaA__ABX58415
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaagaaguccuggagcuacaucguggagacccccaaccccgagaacggcacgugcuaccccggcuacuucgccgacuacgaggagcugcgggagcagcucagcuccgugagcuccuucgagcgcuucgagaucuucccgaaggagagcuccuggcccaaccacaccgucaccggggugagcgccuccugcagccacaacggcaaguccagcuucuaccggaaccugcuguggcucaccgggaagaacggccuguaccccaaccugucccgcagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcgucuaccagauccuggccaucuacuccacgguggccagcagccucgugcugcuggucucccucggggccaucagcuucuggaugugcuccaacggcagccugcagugccggaucugcaucuga

SEQ ID NO: 63231 - RNA, 1698 nt, Artificial Sequence; identical to SEQ ID NO: 62922
  derived and/or modified sequence opt1 from hemagglutinin__InfluenzaA__ABX58426

SEQ ID NO: 63232 - RNA, 1698 nt, Artificial Sequence; identical to SEQ ID NO: 62922
  derived and/or modified sequence opt1 from hemagglutinin__InfluenzaA__ABX58437

SEQ ID NO: 63233 - RNA, 1698 nt, Artificial Sequence; identical to SEQ ID NO: 62918
  derived and/or modified sequence opt1 from hemagglutinin__InfluenzaA__ABX58448

SEQ ID NO: 63234 - RNA, 1698 nt, Artificial Sequence; identical to SEQ ID NO: 62964
  derived and/or modified sequence opt1 from hemagglutinin__InfluenzaA__ABX58459

SEQ ID NO: 63235 - RNA, 1698 nt, Artificial Sequence; identical to SEQ ID NO: 63063
  derived and/or modified sequence opt1 from hemagglutinin__InfluenzaA__ABX58470

SEQ ID NO: 63236 - RNA, 1698 nt, Artificial Sequence; identical to SEQ ID NO: 62964
  derived and/or modified sequence opt1 from hemagglutinin__InfluenzaA__ABX58481

SEQ ID NO: 63237 - RNA, 1698 nt, Artificial Sequence; identical to SEQ ID NO: 62922
  derived and/or modified sequence opt1 from hemagglutinin__InfluenzaA__ABX58492

SEQ ID NO: 63238 - RNA, 1698 nt, Artificial Sequence; identical to SEQ ID NO: 62938
  derived and/or modified sequence opt1 from hemagglutinin__InfluenzaA__ABX58503

SEQ ID NO: 63239 - RNA, 1698 nt, Artificial Sequence; identical to SEQ ID NO: 62964
  derived and/or modified sequence opt1 from hemagglutinin__InfluenzaA__ABX58525

SEQ ID NO: 63240 - RNA, 1698 nt, Artificial Sequence
  derived and/or modified sequence opt1 from hemagglutinin__InfluenzaA__ABX58536
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagcccuggagcuacaucguggagacccccaaccccgagaacggcacgugcuacccgggcuacuucgccgacuacgaggagcugcgggagcagcucuccagcguguccagcuucgagcgcuucgagaucuuccccaaggaguccagcuggcccaaccacaccgucaccgggguguccgccagcugcucccacaacggcaagagcuccuucuaccggaaccugcuguggcucaccgggaagaacggccuguaccccaaccugagccgcuccuacgccaacaacaaggagaaggaggugcucguccuguggggcgugcaccacccgcccaacaucggggaccagcgggcccuguaccacacggagaacgccuacgugagcgucguguccagccacuacagccgccgguucacccccgagaucgccaagcgccccaaggugcgggaccaggagggccgcaucaacuacuacuggacccuccuggagccgggggacaccaucaucuucgaggcgaacggcaaccugaucgcgccccgguucgccuucgcccucucccgcggguucggcagcggcaucaucacguccaacgcccccauggacgagugcgacgccaagugccagacgccccagggggccaucaacagcucccugccguuccagaacguccaccccgugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuacccgaaguacuccgaggagagcaagcucaaccgcgagaagaucgacggcgugaagcuggaguccaugggcgucuaccagauccuggccaucuacagcacgguggccuccagccucgugcugcuggucagccucggggccaucuccuucuggaugugcagcaacggcucccugcagugccggaucugcaucuga

SEQ ID NO: 63241 - RNA, 1698 nt, Artificial Sequence
  derived and/or modified sequence opt1 from hemagglutinin__InfluenzaA__ABX58547
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcaccaagcugcgcauggugaccgggcuccggaacauccccuccauccagacccgcggccuguucggggccaucgccggcuucaucgagggcggguggaccggcauggucgacgggugguacggcuaccaccaccagaacgagcaggggagcggcuacgccgcggaccagaaguccacccagaacgccaucaacggcaucacgaacaaggugaacagcgugaucgagaagaugaacacccaguucaccgccgucgggaaggaguucaacaagcuggagcggcgcauggagaaccucaacaagaagguggacgacggcuuccuggacaucuggaccuacaacgccgagcugcucguccugcuggagaacgagcggacgcucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggcgaucuacuccaccgucgccagcagccucgugcugcuggugucccucggggccaucagcuucuggaugugcuccaacggcagccugcagugccggaucugcaucuga

SEQ ID NO: 63242 - RNA, 1698 nt, Artificial Sequence
  derived and/or modified sequence opt1 from hemagglutinin__InfluenzaA__ABX58558
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggccgcagcuccuucuaccggaaccugcuguggcucaccgggaagaacggccuguaccccaaccugagcaaguccuacgccaacaacaaggagaaggaggugcucguccuguggggcgugcaccacccgcccaacaucggggaccagcgcgcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccauggacaagugcgacgcgaagugccagacgccccagggggccaucaacagcucccugcccuuccagaacguccacccggugaccaucggcgagugccccaaguacgugcgcagcaccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgggagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccgcaucugcaucuga

SEQ ID NO: 63243 - RNA, 1698 nt, Artificial Sequence
  derived and/or modified sequence opt1 from hemagglutinin__InfluenzaA__ABX58569
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgccaccgggguguccgccagcugcucccacaacggcaagagcuccuucuaccgcaaccugcuguggcucaccgggaagaacggccuguaccccaaccugagcaaguccuacgccaacaacaaggagaaggagguccucgugcuguggggcgugcaccacccgcccaacaucggggaccagcgggcccuguaccacacggagaacgccuacgucagcguggugagcucccacuacagccgccgguucacccccgagaucgcgaagcgccccaagguccgggaccaggagggccgcaucaacuacuacuggacccuccuggagcccggggacaccaucaucuucgaggccaacggcaaccugaucgccccgcgguucgccuucgcccucucccgcggguucggcagcggcaucaucacguccaacgcgcccauggacgagugcgacgccaagugccagacgccccagggggccaucaacagcucccugcccuuccagaacgugcacccggugaccaucggcgagugccccaaguacguccggagcaccaagcugcgcauggugaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggucaacagcgugaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgcgaaggagaucgggaacggcugcuucgaguucuaccacaagugcaacgacgagugcauggagagcgugaagaacgggacguacgacuaccccaaguacuccgaggagagcaagcucaaccgcgagaagaucgacggcgucaagcuggaguccaugggcguguaccagauccuggccaucuacagcaccguggccagcucccucguccugcuggugagccucggggccaucuccuucuggaugugcagcaacggcucccugcagugccggaucugcaucuga

SEQ ID NO: 63244 - RNA, 1698 nt, Artificial Sequence; identical to SEQ ID NO: 62918
  derived and/or modified sequence opt1 from hemagglutinin__InfluenzaA__ABX58580

SEQ ID NO: 63245 - RNA, 1698 nt, Artificial Sequence; identical to SEQ ID NO: 62922
  derived and/or modified sequence opt1 from hemagglutinin__InfluenzaA__ABX58591

SEQ ID NO: 63246 - RNA, 1698 nt, Artificial Sequence
  derived and/or modified sequence opt1 from hemagglutinin__InfluenzaA__ABX58602
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcuggagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagccccgggacaccaucaucuucgaggcgaacgggaaccugaucgccccgcgcuucgccuucgcccucucccggggcuucgggagcggcaucaucacguccaacgcccccaugggcgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugccgcaucugcaucuga

SEQ ID NO: 63247 - RNA, 1698 nt, Artificial Sequence; identical to SEQ ID NO: 62955
  derived and/or modified sequence opt1 from hemagglutinin__InfluenzaA__ABX58613

SEQ ID NO: 63248 - RNA, 1698 nt, Artificial Sequence; identical to SEQ ID NO: 62922
  derived and/or modified sequence opt1 from hemagglutinin__InfluenzaA__ABX58624

SEQ ID NO: 63249 - RNA, 1698 nt, Artificial Sequence
  derived and/or modified sequence opt1 from hemagglutinin__InfluenzaA__ABX58635
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggccgcagcuccuucuaccggaaccugcuguggcucaccgggaagaacggccuguaccccagccuguccaagagcuacgccaacaacaaggagaaggaggugcucguccuguggggcgugcaccacccgcccaacaucggggaccagcgcgcccuguaccacacggagaacgccuacgugagcgucguguccagccacuacucccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucagccggggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgcuccaccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggacguacgacuaccccaaguacagcgaggaguccaagcucaaccgggagaagaucgacggcgugaagcuggagagcaugggcgucuaccagauccuggcgaucuacagcaccguggccuccagccucgugcugcuggucucccucggggccaucagcuucuggaugugcuccaacggcagccugcagugccgcaucugcaucuga

SEQ ID NO: 63250 - RNA, 1698 nt, Artificial Sequence; identical to SEQ ID NO: 62918
  derived and/or modified sequence opt1 from hemagglutinin__InfluenzaA__ABX58679

SEQ ID NO: 63251 - RNA, 1698 nt, Artificial Sequence; identical to SEQ ID NO: 62964
  derived and/or modified sequence opt1 from hemagglutinin__InfluenzaA__ABX58701

SEQ ID NO: 63252 - RNA, 1698 nt, Artificial Sequence; identical to SEQ ID NO: 63022
  derived and/or modified sequence opt1 from hemagglutinin__InfluenzaA__ABX58712

SEQ ID NO: 63253 - RNA, 1704 nt, Artificial Sequence
  derived and/or modified sequence opt1 from hemagglutinin__InfluenzaA__ABY19417
auggagaagaucgugcugcuccuggccaucaucagccuggucaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccguggccggguggcugcucggcaacccgaugugcgacgaguucaucaacguccccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcguguccagcgcgugcccguaccagggcguccccuccuucuuccgcaacgugguguggcugaucaagaagaacaacaccuaccccacgaucaagcggagcuacaacaacaccaaccaggaggaccuccugauccugugggggauccaccacuccaacgacgccgccgagcagaccaagcucuaccagaacccgaccacguacaucagcgucggcaccuccacccugaaccagcgccuggugcccaagaucgccacccggagcaaggugaacgggcaguccggccgcauggacuucuucuggacgauccucaagcccaacgacgcgaucaacuucgagagcaacgggaacuucaucgcccccgaguacgccuacaagaucgucaagaagggcgacagcgccaucaugaaguccgagguggaguacggcaacugcaacaccaagugccagaccccgaucggggccaucaacagcuccaugcccuuccacaacauccacccccugaccaucggcgagugccccaaguacgucaagagcaacaagcuggugcucgcgacggggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacagcaacgugaagaaccuguacgacaagguccggcuccagcugcgcgacaacgccaaggagcuggggaacggcugcuucaaguucuaccacaagugcgacaacgagugcauggaguccgugcggaacggcaccuacgacuacccccaguacagcgaggaggcccgccucaagcgggaggagaucuccggggugaagcuggagagcaucggcaccuaccagauccuguccaucuacagcacggucgcguccagccucgcccuggccaucaugguggccgggcugucccucuggaugugcagcaacggcagccugcagugccgcauccgcaucuga

SEQ ID NO: 63254 - RNA, 1704 nt, Artificial Sequence
  derived and/or modified sequence opt1 from hemagglutinin__InfluenzaA__ABY19418
auggagaagaucgugcugcuccuggccaucaucagccuggucaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccguggccggguggcugcucggcaacccgaugugcgacgaguucaucaacguccccgaguggagcuacaucguggagaaggccaaccccgccaacgaccugugcuaccccggggacuucaacgacuacgaggagcugaagcaccuccugucccggaucaaccacuucgagaagauccagaucauccccaagagcuccuggagcgaccacgaggccuccagcggcguguccagcgcgugcccguaccagggcguccccuccuucuuccgcaacgugguguggcugaucaagaagaacaacaccuaccccacgaucaagcggagcuacaacaacaccaaccaggaggaccuccugauccugugggggauccaccacuccaacgacgccgccgagcagaccaagcucuaccagaacccgaccacguacaucagcgucggcaccuccacccugaaccagcgccuggugcccaagaucgccacccggagcaaggugaacgggcaguccggccgcauggacuucuucuggacgauccucaagcccaacgacgcgaucaacuucgagagcaacgggaacuucaucgcccccgaguacgccuacaagaucgucaagaagggcgacagcgccaucaugaaguccgagguggaguacggcaacugcaacaccaagugccagaccccgaucggggccaucaacagcuccaugcccuuccacaacauccacccccugaccaucggcgagugccccaaguacgucaagagcaacaagcuggugcucgcgacggggcugcggaacuccccgcugcgcgagcggcgccggaagcgcggccucuucggcgccaucgccggguucaucgagggcggguggcagggcaugguggacgggugguacggcuuccaccacagcaacgagcagggcuccggguacgccgccgacaaggagagcacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucuccggggugaagcuggagagcaucggcaccuaccagauccuguccaucuacagcacggucgcguccagccucgcccuggccaucaugguggccgggcugucccucuggaugugcagcaacggcagccugcagugccgcaucugcaucuga

SEQ ID NO: 63255 - RNA, 1704 nt, Artificial Sequence
  derived and/or modified sequence opt1 from hemagglutinin__InfluenzaA__ABY19419
auggagaagaucgugcugcuccuggccaucaucagccuggucaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccguggccggguggcugcucggcaacccgaugugcgacgaguucaucaacguccccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcguguccagcgcgugcccguaccagggcguccccuccuucuuccgcaacgugguguggcugaucaagaagaacaacaccuaccccacgaucaagcggagcuacaacaacaccaaccaggaggaccuccugauccugugggggauccaccacuccaacgacgccgccgagcagaccaagcucuaccagaacccgaccacguacaucagcgucggcaccuccacccugaaccagcgccuggugcccaagaucgccacccggagcaaggugaacgggcaguccggccgcauggacuucuucuggacgauccucaagcccaacgacgcgaucaacuucgagagcaacgggaacuucaucgcccccgaguacgccuacaagaucgucaagaagggcgacagcgccaucaugaaguccgagguggaguacggcaacugcaacaccaagugccagaccccgaucggggccaucaacagcuccaugcccuuccacaacauccacccccugaccaucggcgagugccccaaguacgucaagagcaacaagcuggugcucgcgacggggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggucaacuccaucaucgacaagaugaacacccaguucgaggccguggggcgggaguucaacaaccuggagcgccggaucgagaaccugaacaagaagauggaggacggcuuccucgacguguggacguacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccucaagcgggaggagaucuccggggugaagcuggagagcaucggcaccuaccagauccuguccaucuacagcacggucgcguccagccucgcccuggccaucaugguggccgggcugucccucuggaugugcagcaacggcagccugcagugccgcaucugcaucuga

SEQ ID NO: 63256 - RNA, 1698 nt, Artificial Sequence; identical to SEQ ID NO: 63063
  derived and/or modified sequence opt1 from hemagglutinin__InfluenzaA__ABY51017

SEQ ID NO: 63257 - RNA, 1701 nt, Artificial Sequence; identical to SEQ ID NO: 62936
  derived and/or modified sequence opt1 from hemagglutinin__InfluenzaA__ABY51028

SEQ ID NO: 63258 - RNA, 1698 nt, Artificial Sequence
  derived and/or modified sequence opt1 from hemagglutinin__InfluenzaA__ABY51039
augaaggugaagcugcucguccugcugugcaccuucaccgccacgaacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggccacuucgccgacuacgaggagcugcgcgagcagcucuccagcguguccagcuucgagcgguucgagaucuucccgaaggaguccagcuggcccaaccacaccgucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagaaggcccuguaccacacggagaacgccuacgugagcgucgugagcucccacuacagccggaaguucacccccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaaggggcagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggcgugaagcucgagagcaugggggucuaccagauccuggccaucuacuccaccguggccagcagccuggugcuccuggucucccugggcgccaucagcuucuggaugugcuccaacgggagccuccagugccggaucugcaucuga

SEQ ID NO: 63259 - RNA, 1698 nt, Artificial Sequence
  derived and/or modified sequence opt1 from hemagglutinin__InfluenzaA__ABY51050
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacagcaagugccagacgccccagggggcgaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggcgaucuacagcaccguggccuccagccuggugcuccuggucucccugggggccaucagcuucuggaugugcuccaacggcagccuccagugccggaucugcaucuga

SEQ ID NO: 63260 - RNA, 1698 nt, Artificial Sequence; identical to SEQ ID NO: 63022
  derived and/or modified sequence opt1 from hemagglutinin__InfluenzaA__ABY51061

SEQ ID NO: 63261 - RNA, 1698 nt, Artificial Sequence
  derived and/or modified sequence opt1 from hemagglutinin__InfluenzaA__ABY51072
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcaccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgccgcggaccagaaguccacccagaacgccaucaacggcaucaccaacaaggugaacagcgugaucgagaagaugaacacgcaguucaccgccgucgggaaggccuucaacaagcuggagcggcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggugaagucccagcugaagaacaacgcgaaggagaucgggaacggcugcuucgaguucuaccacaagugcaacgacgagugcauggagagcgucaagaacgggacguacgacuaccccaaguacuccgaggagagcaagcucaaccgcgagaagaucgacggcgugaagcuggaguccaugggcguguaccagauccuggccaucuacagcaccgucgccagcucccucgugcugcuggugagccucggggccaucuccuucuggaugugcagcaacggcucccugcagugccggaucugcaucuga

SEQ ID NO: 63262 - RNA, 1698 nt, Artificial Sequence; identical to SEQ ID NO: 62964
  derived and/or modified sequence opt1 from hemagglutinin__InfluenzaA__ABY51083

SEQ ID NO: 63263 - RNA, 1698 nt, Artificial Sequence; identical to SEQ ID NO: 62922
  derived and/or modified sequence opt1 from hemagglutinin__InfluenzaA__ABY51094

SEQ ID NO: 63264 - RNA, 1698 nt, Artificial Sequence; identical to SEQ ID NO: 63063
  derived and/or modified sequence opt1 from hemagglutinin__InfluenzaA__ABY51105

SEQ ID NO: 63265 - RNA, 1698 nt, Artificial Sequence; identical to SEQ ID NO: 62922
  derived and/or modified sequence opt1 from hemagglutinin__InfluenzaA__ABY51116

SEQ ID NO: 63266 - RNA, 1701 nt, Artificial Sequence
  derived and/or modified sequence opt1 from hemagglutinin__InfluenzaA__ABY51127
augaagaccaucaucgcccugagcuacauccucugcaugguguucgcccagaagcugcccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaagugggaccucuucguggagcgcuccaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcaccucaaguucaaguaccccgcccugaacgugaccaugcccaacaacgagaaguucgacaagcuguacaucuggggcguccaccaccccgggaccgacaacgaccagguguuccucuacgcgcaggccagcgggcggaucaccguguccacgaagcgcagccagcagaccgucaucccgaacaucggcagccggccccgcgugcggaacauccccucccgcaucagcaucuacuggaccaucgugaagcccggcgacauccugcugaucaacuccaccgggaaccucaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcuggcgaccggcaugcgcaacgugcccgagaagcagacgcgggggaucuucggcgccaucgccggguucaucgagaacggcugggagggcauggucgacgggugguacggcuuccgccaccagaacagcgaggggaucggccaggccgccgaccucaaguccacccaggcggccaucgaccagaucaacgggaagcugaaccggcugaucggcaagaccaacgagaaguuccaccagaucgagaaggaguucagcgagguggagggccgcauccaggaccucgagaaguacguggaggacaccaagaucgaccugugguccuacaacgccgagcugcucgucgcccuggagaaccagcacacgaucgaccugaccgacagcgagaugaacaagcuguucgagaagaccaagaagcagcuccgggagaacgccgaggacauggggaacggcugcuucaagaucuaccacaagugcgacaacgcgugcaucggguccauccgcaacggcaccuacgaccacgacguguaccgcgacgaggcccugaacaaccgguuccagaucaaggggguggagcucaagagcggcuacaaggacuggauccuguggaucuccuucgccaucagcugcuuccugcucugcgucgcccugcugggcuucaucaugugggccugccagaaggggaacauccgcugcaacaucugcaucuga

SEQ ID NO: 63267 - RNA, 1698 nt, Artificial Sequence
  derived and/or modified sequence opt1 from hemagglutinin__InfluenzaA__ABY51138
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugagcuccuucgagcgcuucgagaucuucccgaaggagagcuccuggcccaaccacaccgucaccggggugagcgccuccugcagccacaacggcaaguccagcuucuaccggaaccugcuguggcucaccgggaagaacggccuguaccccaaccugucccgcagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacuccaacgugaagaaccuguacgagaaggucaagauccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccuccagccucgugcugcuggucagccucggggccaucuccuucuggaugugcagcaacggcucccugcagugccggaucugcaucuga

SEQ ID NO: 63268 - RNA, 1698 nt, Artificial Sequence; identical to SEQ ID NO: 62922
  derived and/or modified sequence opt1 from hemagglutinin__InfluenzaA__ABY51149

SEQ ID NO: 63269 - RNA, 1698 nt, Artificial Sequence
  derived and/or modified sequence opt1 from hemagglutinin__InfluenzaA__ABY51160
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggaccgccacaacgggaagcucugccugcugaagggcaucgcgccccuccagcuggggaacugcagcgucgccggcuggauccuggggaacccggagugcgagcuccugaucuccaaggagagcugguccuacaucguggagacccccaaccccgagaacggcacgugcuaccccggcuacuucgccgacuacgaggagcugcgggagcagcucagcuccgugagcuccuucgagcgcuucgagaucuucccgaaggagagcuccuggcccaaccacaccgucaccggggugagcgccuccugcagccacaacggcaaguccagcuucuaccggaaccugcuguggcucaccgggaagaacggccuguaccccaaccuguccaagagcuacgccaacaacaaggagaaggaggugcucguccuguggggcgugcaccacccgcccaacaucggggaccagcgcgcccuguaccacacggagaacgccuacguguccgucgugagcagccacuacucccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucagccggggguucggcuccggcaucaucacgagcaacgcccccauggacaagugcgacgcgaagugccagacgccccagggggccaucaacuccagccugcccuuccagaacguccacccggugaccaucggcgagugccccaaguacgugcgcuccgccaagcugcggauggucaccgggcuccgcaacauccccagcauccagucccggggccuguucggggccaucgccggcuucaucgagggcggguggaccggcaugaucgacgggugguacggcuaccaccaccagaacgagcaggggagcggcuacgcggccgaccagaaguccacccagaacgccaucaacggcaucaccaacaaggugaacagcgugaucgagaagaugaacacccaguucacggccgucgggaaggaguucaacaagcuggagcgccggauggagaaccucaacaagaagguggacgacggcuuccuggacaucuggaccuacaacgccgagcugcucguccugcuggagaacgagcgcacccucgacuuccacgacuccaacgugaagaaccuguacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagagcaugggcguguaccagauccuggccaucuacuccacggucgccagcagccucgugcugcuggugucccucggggccaucagcuucuggaugugcuccaacggcagccugcagugccgcaucugcaucuga

SEQ ID NO: 63270 - RNA, 1698 nt, Artificial Sequence
  derived and/or modified sequence opt1 from hemagglutinin__InfluenzaA__ABY51171
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccaugggggagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacgacgagugcauggagagcgugaagaacggcaccuacgacuaccagaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 63271 - RNA, 1698 nt, Artificial Sequence; identical to SEQ ID NO: 62918
  derived and/or modified sequence opt1 from hemagglutinin__InfluenzaA__ABY51182

SEQ ID NO: 63272 - RNA, 1698 nt, Artificial Sequence; identical to SEQ ID NO: 62938
  derived and/or modified sequence opt1 from hemagglutinin__InfluenzaA__ABY51193

SEQ ID NO: 63273 - RNA, 1698 nt, Artificial Sequence; identical to SEQ ID NO: 62922
  derived and/or modified sequence opt1 from hemagglutinin__InfluenzaA__ABY51237

SEQ ID NO: 63274 - RNA, 1698 nt, Artificial Sequence; identical to SEQ ID NO: 62938
  derived and/or modified sequence opt1 from hemagglutinin__InfluenzaA__ABY51248

SEQ ID NO: 63275 - RNA, 1698 nt, Artificial Sequence; identical to SEQ ID NO: 62918
  derived and/or modified sequence opt1 from hemagglutinin__InfluenzaA__ABY51259

SEQ ID NO: 63276 - RNA, 1701 nt, Artificial Sequence; identical to SEQ ID NO: 62995
  derived and/or modified sequence opt1 from hemagglutinin__InfluenzaA__ABY51270

SEQ ID NO: 63277 - RNA, 1707 nt, Artificial Sequence
  derived and/or modified sequence opt1 from hemagglutinin__InfluenzaA__ABY76282
auggagaagaucgugcugcuccuggccaucgucagccuggugaaguccgaccagaucugcaucggcuaccacgccaacaacagcaccgagcacguggacaccaucauggagaagaacgucacggugacccacgcgcaggacauccucgagaaggcccacaacgggcgccugugcgaccuggacggcgugaagccccucauccugcgggacugcuccgucgccggguggcugcucggcaacccgaugugcgacgaguuccugaacgugcccgaguggagcuacaucguggagaagaacaaccccgccaacgaccugugcuaccccgggaacuucaacgacuacgaggagcucaagcaccuccugucccgcaucaaccacuucgagaagauccagaucauccccaagagcuccuggagcgaccacgaggccuccagcggcgucuccagcgcgugcccguaccagggccgguccagcuucuuccgcaacgugguguggcugaucaagaagaacgacgccuaccccaccaucaagcgguccuacaacaacaccaaccaggaggaccugcugguccucugggggauccaccaccccaacgacgccgccgagcagacgcgccuguaccagaacccgaccaccuacaucagcgugggcaccuccacgcugaaccagcggcucgugcccaagaucgcgacccgcagcaaggucaacgggcaguccggccggauggaguucuucuggaccauccugaagcccaacgacgccaucaacuucgagagcaacgggaacuucaucgcccccgagaacgccuacaagaucgugaagaagggcgacagcaccaucaugaaguccgagcuggaguacggcaacugcaacacgaagugccagaccccgaucggggccaucaacagcuccaugcccuuccacaacauccacccccucaccaucggcgagugccccaaguacgucaagagcaaccgccuggugcuggcgaccgggcuccggaacuccccgcagggcgagcgccggcgcaagaagcggggccuguucggggccaucgccggcuucaucgagggcggguggcaggggaugguggacggcugguacggcuaccaccacagcaacgagcagggguccggcuacgccgccgacaaggagagcacgcagaaggcgaucgacggggugaccaacaaggucaacuccaucaucgacaagaugaacacccaguucgaggccgugggccgcgaguucaacaaccuggagcggcgcaucgagaaccucaacaagaagauggaggacggguuccuggacguguggaccuacaacgccgagcugcucguccugauggagaacgagcggacgcuggacuuccacgacagcaacgugaagaaccucuacgacaagguccgccugcagcugcgggacaacgccaaggagcucggcaacggcugcuucgaguucuaccaccgcugcgacaacgagugcauggaguccgugcgcaacgggaccuacgacuacccccaguacagcgaggaggcccggcugaagcgcgaggagaucuccggcgugaagcuggagagcaucgggaccuaccagauccucuccaucuacagcaccgucgcguccagccuggcccuggccaucaugguggccggccucucccuguggaugugcagcaacgggagccugcagugccggaucugcaucuga

SEQ ID NO: 63278 - RNA, 1701 nt, Artificial Sequence
  derived and/or modified sequence opt1 from hemagglutinin__InfluenzaA__ABY81349
augaaggccaagcugcucgugcugcugugcgcccucagcgcgaccgacgccgacaccaucugcaucggcuaccacgccaacaacuccacggacaccgucgacaccgugcuggagaagaacgugaccgucacgcacagcgugaaccugcucgaggacucccacaacgggaagcugugccgccugaagggcaucgcgccccuccagcuggggaagugcagcaucgccggcuggauccuggggaacccggagugcgagucccucuucagcaagaaguccuggagcuacaucgccgagacccccaacuccgagaacgggaccugcuaccccggcuacuucgccgacuacgaggagcugcgggagcagcugagcuccgugagcuccuucgagcgcuucgagaucuuccccaaggagcggagcuggccgaagcacaacgucacccgcggggugacggccgccugcucccacaagggcaagagcuccuucuaccggaaccuccuguggcugaccgagaagaacgggagcuaccccaaccucuccaagagcuacgugaacaacaaggagaaggagguccuggugcuguggggcgugcaccaccccagcaacaucaaggaccagaagaccaucuaccagaaggagaacgcguacgucuccguggugagcuccaacuacaaccgccgguucacccccgagaucgccaagcgcccgaagguccgggaccaggaggggcgcaucaacuacuacuggacgcuccuggagcccggcgacaccaucaucuucgaggccaacggcaaccugaucgcccccugguacgccuucgcgcucagccggggguucggcuccgggaucaucaccagcaacgccuccauggacgagugcgacaccaagugccagacgccccagggcgccaucaacagcucccugccguuccagaacgugcaccccgugaccaucggcgagugccccaaguacguccgcagcaccaagcugcggauggugaccgggcuccgcaacauccccuccauccagagccggggccuguucggggccaucgccggcuucaucgagggcggcuggacgggcaugaucgacgggugguacggcuaccaccaccagaacgagcagggguccggcuacgcggccgaccagaaguccacccagaacgccaucaacgggaucaccaacaaggugaacagcgucaucgagaagaugaacacccaguucacggccgugggcaaggaguucaacaagcuggagaagcgcauggagaaccucaacaagaagguggacgacggcuuccuggacaucuggaccuacaacgccgagcugcucguccugcuggagaacgagcggacccucgacuuccacgacagcaacgugaagaaccuguacgagaaggucaagucccagcugaagaacaacgcgaaggagguggggaacggcugcuucgaguucuaccacaagugcaacaacgagugcauggagagcgugaagaacgggaccuacgacuacccgaaguacuccgaggagagcaagcucaaccgcgagaagaucgacggcgucaagcuggagagcauggggguguaccagauccuggccaucuacuccacgguggccagcucccucguccugcuggugagccucggcgccaucuccuucuggaugugcagcaacggcucccugcagugccggaucugcaucuga

SEQ ID NO: 63279 - RNA, 1701 nt, Artificial Sequence; identical to SEQ ID NO: 62936
  derived and/or modified sequence opt1 from hemagglutinin__InfluenzaA__ABY81371

SEQ ID NO: 63280 - RNA, 1698 nt, Artificial Sequence; identical to SEQ ID NO: 62922
  derived and/or modified sequence opt1 from hemagglutinin__InfluenzaA__ABY81382

SEQ ID NO: 63281 - RNA, 1698 nt, Artificial Sequence; identical to SEQ ID NO: 62964
  derived and/or modified sequence opt1 from hemagglutinin__InfluenzaA__ABY81393

SEQ ID NO: 63282 - RNA, 1698 nt, Artificial Sequence
  derived and/or modified sequence opt1 from hemagglutinin__InfluenzaA__ABY81415
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccucccccgagaacggcacgugcuaccccggcuacuucgccgacuacgaggagcugcgcgagcagcucagcuccgugagcuccuucgagcgguucgagaucuucccgaaggagagcuccuggcccaaccacaccgucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacgugagcgucguguccagccacuacucccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucagccgcggguucggcuccggcaucaucacgagcaacgcccccaugggggagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggguggaccgggaugguggacggcugguacggguaccaccaccagaacgagcagggcagcggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacuccaacgugaagaaccuguacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcucaaccgcgagaagaucgacggcgugaagcuggagagcaugggggucuaccagauccuggccaucuacagcacgguggccuccagccucgugcugcuggucucccucggcgccaucagcuucuggaugugcuccaacgggagccugcagugccggaucugcaucuga

SEQ ID NO: 63283 - RNA, 1701 nt, Artificial Sequence; identical to SEQ ID NO: 62936
  derived and/or modified sequence opt1 from hemagglutinin__InfluenzaA__ACA24502

SEQ ID NO: 63284 - RNA, 1698 nt, Artificial Sequence
  derived and/or modified sequence opt1 from hemagglutinin__InfluenzaA__ACA24513
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucaacuccgugagcuccuucgagcgguucgagaucuucccgaaggagagcuccuggcccaaccacaccgugaccggggucagcgccuccugcagccacaacggcaaguccagcuucuaccgcaaccugcuguggcucaccgggaagaacggccuguaccccaaccuguccaagagcuacgccaacaacaaggagaaggaggugcucgugcuguggggcguccaccacccgcccaacaucggggaccagcgggcccuguaccacacggagaacgccuacguguccguggucagcagccacuacucccgccgguucacccccgagaucgccaagcgccccaaggugcgggaccaggagggccgcaucaacuacuacuggacccuccuggagccccgggacaccaucaucuucgaggcgaacgggaaccugaucgccccgcgcuucgccuucgcccucagccggggcuucggguccggcaucaucacgagcaacgcccccauggacgagugcgacgcgaagugccagacgccccagggcgccaucaacuccagccugcccuuccagaacgugcacccggucaccaucggggagugccccaaguacgugcgcuccaccaagcugcggauggugaccggccuccgcaacauccccagcauccagucccgggggcuguucggcgccaucgccggguucaucgagggcggcuggaccgggauggucgacggcugguacggguaccaccaccagaacgagcagggcagcggguacgccgcggaccagaaguccacccagaacgccaucaacggcaucaccaacaaggugaacagcgugaucgagaagaugaacacgcaguucaccgccgucggcaaggaguucaacaagcuggagcgccggauggagaaccucaacaagaagguggacgacggguuccuggacaucuggaccuacaacgccgagcugcucguccugcuggagaacgagcgcacccucgacuuccacgacuccaacgugaagaaccuguacgagaaggucaagagccagcugaagaacaacgccaaggagaucggcaacgggugcuucgaguucuaccacaagugcaacgacgagugcauggaguccgugaagaacggcacguacgacuaccccaaguacagcgaggaguccaagcucaaccgggagaagaucgacggggugaagcuggagagcaugggcguguaccagauccuggcgaucuacuccaccgucgccagcagccucgugcugcuggugucccucggcgccaucagcuucuggaugugcuccaacgggagccugcagugccgcaucugcaucuga

SEQ ID NO: 63285 - RNA, 1698 nt, Artificial Sequence; identical to SEQ ID NO: 62922
  derived and/or modified sequence opt1 from hemagglutinin__InfluenzaA__ACA24524

SEQ ID NO: 63286 - RNA, 1701 nt, Artificial Sequence
  derived and/or modified sequence opt1 from hemagglutinin__InfluenzaA__ACA24689
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagaucaucgacggggagaacugcacccucaucgacgcccugcugggcgacccccagugcgacggcuuccagaacaagaagugggaccucuucguggagcgcuccaaggccuacagcaacugcuaccccuacgacgugccggacuacgcgucccugcggagccuggucgccuccagcgggacgcucgaguucaacaacgaguccuucaacuggaccggcgugacccagaacgggaccagcuccgccugcaagcgcggcagcaacaacuccuucuucagccggcugaacuggcugacgcacuccaaguucaaguaccccgcccucaacgugaccaugcccaacaacgaggaguucgacaagcuguacaucuggggcguccaccaccccgggaccgacaacgaccagaucuuccuguacgcgcaggccagcggccgcaucaccguguccacgaagcggagccagcagaccgugaucccgaacaucgggagccgcccccggguccgcaacauccccucccggaucagcaucuacuggaccaucgugaagcccggcgacauccuccugaucaacuccaccgggaaccugaucgccccgcgcggcuacuucaagauccggagcggcaaguccagcaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccugaaguccacccaggcggccaucgaccagaucaacggcaagcucaaccgccugaucgggaagaccaacgagaaguuccaccagaucgagaaggaguucagcgaggucgagggccggauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacuacgucuaccgcgacgaggcccugaacaaccgcuuccagaucaagggcaucgagcucaagagcggguacaaggacuggauccuguggaucuccuucgccaucagcugcuuccugcugugcguggcccuccugggcuucaucaugugggccugccagaaggggaacauccggugcaacaucugcaucuga

SEQ ID NO: 63287 - RNA, 1701 nt, Artificial Sequence
  derived and/or modified sequence opt1 from hemagglutinin__InfluenzaA__ACA24700
augaagaccaucaucgcccugagcuacauccucugccugguguucgcccagaagcugcccggcaucgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcucccaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgcggcagcaacaacuccuucuucagccggcugaacuggcucacgcacuccaaguucaaguaccccgcccugaacgugaccaugcccaacaacgaggaguucgacaagcuguacaucuggggcguccaccaccccgggaccgacaacgaccagaucuuccucuacgcgcaggccagcggccgcaucaccguguccacgaagcggagccagcagaccgugaucccgaacaucgggagccgcccccggguccgcaacauccccucccggaucagcaucuacuggaccaucgugaagcccggcgacauccugcugaucaacuccaccgggaaccucaucgccccgcgcggcuacuucaagauccggagcggcaaguccagcaucaugcgcuccgacgcccccaucgggaagugcaacagcgagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccucaaguccacccaggcggccaucgaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacgacgucuaccgcgacgaggcccugaacaaccgcuuccagaucaagggcguggagcucaagagcggguacaaggacuggauccuguggaucuccuucgccaucagcugcuuccugcucugcguggcccugcugggcuucaucaugugggccugccagaaggggaacauccggugcaacaucugcaucuga

SEQ ID NO: 63288 - RNA, 1698 nt, Artificial Sequence
  derived and/or modified sequence opt1 from hemagglutinin__InfluenzaA__ACA28846
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcauccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 63289 - RNA, 1701 nt, Artificial Sequence
  derived and/or modified sequence opt1 from hemagglutinin__InfluenzaA__ACA33749
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcuccugcauccgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcccaggcguccgggcggaucaccgugagcacgaagcgcagccagcagaccgugaucccgaacaucggcucccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgccugcaucgggagcauccgcaacggcaccuacgaccacgacgucuaccgcgacgaggcgcucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 63290 - RNA, 1698 nt, Artificial Sequence; identical to SEQ ID NO: 62918
  derived and/or modified sequence opt1 from hemagglutinin__InfluenzaA__ACA96519

SEQ ID NO: 63291 - RNA, 1659 nt, Artificial Sequence
  derived and/or modified sequence opt1 from hemagglutinin__InfluenzaA__ACC55270
augaacacccagauccuggccuucaucgccugcgugcucaccggcgucaagggggacaagaucugccugggccaccacgcgguggccaacgggacgaaggugaacacccugaccgagcgcggcaucgaggucgugaacgccaccgagacgguggagaccaccaacaucaagaagaucugcacccaggggaagcggcccacggaccucggccagugcggccugcuggggacccucaucggcccgccccagugcgaccaguuccuggaguucagcuccgaccugaucaucgagcgccgggaggggaccgacaucugcuaccccggccgcuucaccaacgaggagagccuccggcagauccugcgccgguccgggggcaucggcaaggagagcaugggguucacguacuccggcauccgcaccaacggggccaccagcgccugcacccgguccggcagcuccuucuacgcggagaugaaguggcugcucagcaacuccgacaacgccgccuucccccagaugacgaaggccuaccgcaacccgcggaacaagcccgcgcugaucaucuggggcguccaccacagcgaguccgugagcgagcagaccaagcuguacggguccggcaacaagcucaucaccgugcgcagcuccaaguaccagcagagcuucacccccaaccccggggcccggcgcaucgacuuccacuggcugcugcucgacccgaacgacacggucaccuucaccuucaacggcgccuucaucgcccccgaccggaccuccuucuuccgcggggagagccugggcgugcagagcgacgcgccccuggacuccagcugccggggcgacugcuuccacuccgggggcacgaucgugagcucccuccccuuccagaacaucaacagccgcaccgucgggaagugcccgcgguacgugaagcagaagucccugcugcucgccaccggcaugcgcaacgugcccgagaagcccaagccccgggggcuguucggcgccaucgccggcuucaucgagaacgggugggagggccugaucaacgggugguacggcuuccgccaccagaacgcccagggggagggcaccgccgcggacuacaagagcacgcaguccgccaucgaccagaucaccggcaagcucaaccgccugaucgggaagaccaaccagcaguucgagcugaucgacaacgaguucaacgagaucgagcagcagaucggcaacgucaucaacuggacccgggacgccaugacggagaucuggagcuacaacgccgagcuccugguggccauggagaaccagcacaccaucgaccuggcggacuccgagaugagcaagcucuacgagcgcgugaagaagcagcugcgggagaacgccgaggaggacgggaccggcugcuucgagaucuuccacaagugcgacgaccagugcauggaguccauccgcaacaacaccuacgaccacacgcaguaccggaccgagagccugcagaaccgcauccagaucgacccggucaagcucuccagcggcuacaaggacaucauccugugguucuccuucggggccagcugcuuccugcuccuggccaucgccaugggccugguguucaucugcaucaagaacgggaacaugcagugcaccaucugcaucuga

SEQ ID NO: 63292 - RNA, 1698 nt, Artificial Sequence; identical to SEQ ID NO: 62922
  derived and/or modified sequence opt1 from hemagglutinin__InfluenzaA__ACC61964

SEQ ID NO: 63293 - RNA, 1698 nt, Artificial Sequence
  derived and/or modified sequence opt1 from hemagglutinin__InfluenzaA__ACC61975
augaaggugaagcugcucguccugcugugcaccuucaccgccagcuacgccgacacgaucugcaucggcuaccacgcgaacaacuccaccgacaccguggacaccgugcucgagaagaacgucacggugacccacagcgugaaccugcuggaggacucccacaacgggaagcucugccugcugaagggcaucgcgccccuccagcuggggaacugcagcgucgccggcuggauccuggggaacccggagugcgagcuccugaucuccaaggagagcugguccuacaucguggaggugcccaaccccgagaacgggaccugcuaccccggcuacuucgccgacuacgaggagcugcgcgagcagcucagcuccaucagcuccuucgagcgguucgagaucuucccgaaggagagcuccuggcccaaccacaccgucacgggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggcgaccagcgggcccuguaccacaccgagaacgccuacgugagcgucguguccagccacuacucccgccgguucacccccgagaucgccaagcgccccaaggugcgggaccaggagggccgcaucaacuacuacuggacgcuccuggagcccggggacaccaucaucuucgaggcgaacggcaaccugaucgccccgcgguucgccuucgcccucagccgcgggcugggcuccggcaucaucaccagcaacgcccccauggacgagugcgacgcgaagugccagacgccccagggggccaucaacuccagccugcccuuccagaacguccacccggugaccaucggcgagugccccaaguacgugcgguccgccaagcuccgcauggucaccgggcugcggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcucgagcggcgcauggagaaccugaacaagaaggucgacgacggcuuccuggacaucuggaccuacaacgccgagcuccuggugcugcucgagaacgagcggacgcuggacuuccacgacuccaacgugaagaaccuguacgagaaggucaagagccagcucaagaacaacgcgaaggagaucgggaacggcugcuucgaguucuaccacaagugcaacaacgagugcauggaguccgugaagaacgggaccuacgacuaccccaaguacagcgaggaguccaagcugaaccgcgagaagaucgacggcgugaagcuggagagcaugggcgucuaccagauccucgccaucuacagcaccguggccuccagccuggugcugcucgucucccugggggccaucagcuucuggaugugcuccaacggcagccugcagugccggaucugcaucuga

SEQ ID NO: 63294 - RNA, 1698 nt, Artificial Sequence; identical to SEQ ID NO: 62918
  derived and/or modified sequence opt1 from hemagglutinin__InfluenzaA__ACC61986

SEQ ID NO: 63295 - RNA, 1698 nt, Artificial Sequence
  derived and/or modified sequence opt1 from hemagglutinin__InfluenzaA__ACD37430
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccacccacaccgugaccggggucuccgccagcugcucccacaacggcaagagcuccuucuaccgcaaccugcuguggcucacggggaagaacggccuguaccccaaccugagcaaguccuacgugaacaacaaggagaaggaggugcucguccuguggggcgugcaccacccgcccaacaucggggaccagcgggcccuguaccacaccgagaacgccuacgugagcgucgugagcucccacuacagccgccgguucacccccgagaucgccaagcgccccaaggugcgggaccaggagggccgcaucaacuacuacuggacccuccuggagcccggggacacgaucaucuucgaggcgaacggcaaccugaucgccccgugguacgccuucgcccucucccggggguucggcagcggcaucaucaccuccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacaacgagugcauggagagcgugaagaacgggacguacgacuaccccaaguacuccgaggagagcaagcucaaccgggagaagaucgacggcgugaagcuggaguccaugggcgucuaccagauccuggccaucuacagcaccguggccagcucccucgugcugcuggucagccucggggccaucuccuucuggaugugcagcaacggcucccugcagugccgcaucugcaucuga

SEQ ID NO: 63296 - RNA, 1698 nt, Artificial Sequence
  derived and/or modified sequence opt1 from hemagglutinin__InfluenzaA__ACD37507
augaaggccaagcugcucgugcugcugugcaccuucgccgcgaccuacgccgacacgaucugcaucggcuaccacgccaacaacagcaccgacaccgucgacaccgugcucgagaagaacgugacggucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacaccgugacgggggucuccgccagcugcucccacaacggcgagagcuccuucuaccgcaaccugcuguggcucaccgggaagaacggccuguaccccaaccugagcaaguccuacgccaacaacaaggagaaggaggugcucgugcuguggggcguccaccacccgcccaacaucggcaaccagaaggcccuguaccacaccgagaacgcguacgugagcguggucagcucccacuacagccggaaguucacccccgagaucgccaagcgccccaaggugcgggaccaggagggccgcaucaacuacuacuggacgcuccuggagcccggggacaccaucaucuucgaggccaacggcaaccugaucgccccgcgguacgccuucgcgcucucccgcggguucggcagcggcaucaucaacuccaacgcccccauggacaagugcgacgccaagugccagacgccccagggggccaucaacagcucccugcccuuccagaacgugcacccggucaccaucggcgagugccccaaguacgugcggagcgccaagcugcgcauggugaccgggcuccggaacauccccuccauccagagccgcggccuguucggggcgaucgccggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacgcaguucaccgcggucgggaaggaguucaacaagcuggagcggcgcauggagaaccucaacaagaagguggacgacggcuucaucgacaucuggaccuacaacgccgagcugcugguccuccuggagaacgagcggacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagagcaagcugaaccgcgagaagaucgacggcgugaagcucgaguccaugggcguguaccagauccuggccaucuacagcaccgucgccagcucccuggugcuccuggugagccugggggcgaucuccuucuggaugugcagcaacggcucccuccagugccggaucugcaucuga

SEQ ID NO: 63297 - RNA, 1698 nt, Artificial Sequence; identical to SEQ ID NO: 63063
  derived and/or modified sequence opt1 from hemagglutinin__InfluenzaA__ACD56113

SEQ ID NO: 63298 - RNA, 1698 nt, Artificial Sequence; identical to SEQ ID NO: 62922
  derived and/or modified sequence opt1 from hemagglutinin__InfluenzaA__ACD56124

SEQ ID NO: 63299 - RNA, 1701 nt, Artificial Sequence; identical to SEQ ID NO: 62995
  derived and/or modified sequence opt1 from hemagglutinin__InfluenzaA__ACD56258

SEQ ID NO: 63300 - RNA, 1701 nt, Artificial Sequence; identical to SEQ ID NO: 62737
  derived and/or modified sequence opt1 from hemagglutinin__InfluenzaA__ACD56269

SEQ ID NO: 63301 - RNA, 1698 nt, Artificial Sequence
  derived and/or modified sequence opt1 from hemagglutinin__InfluenzaA__ACD56280
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccggcaacggcacgugcuaccccggguacuucgccgacuacgaggagcugcgcgagcagcucuccagcguguccagcuucgagcgguucgagaucuucccgaaggaguccagcuggcccaaccacaccgugaccggcgucuccgccagcugcucccacaacggcaagagcuccuucuaccgcaaccugcuguggcucaccgggaagaacgggcuguaccccaaccugagcaaguccuacgccaacaacaaggagaaggaggugcucgugcuguggggcguccaccacccgcccaacaucggcgaccagcgggcccuguaccacacggagaacgccuacgugagcguggucagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgcgguucgccuucgcccucucccgcggcuucggcagcgggaucaucacguccaacgcccccauggacgagugcgaggcgaagugccagacgccccagggcgccaucaacagcucccugcccuuccagaacgugcacccggucaccaucggggagugccccaaguacgugcggagcaccaagcugcgcauggugaccggccuccggaacauccccuccauccagagccgcgggcuguucggcgccaucgccggcuucaucgagggcggguggaccgggauggucgacggcugguacggguaccaccaccagaacgagcagggcuccggcuacgccgcggaccagaaguccacccagaacgccaucaacgggaucaccaacaaggugaacagcgugaucgagaagaugaacacgcaguucaccgccgucggcaaggaguucaacaagcuggagcggcgcauggagaaccucaacaagaagguggacgacggguuccuggacaucuggaccuacaacgccgagcugcucguccugcuggagaacgagcggacccucgacuuccacgacagcaacgugaagaaccuguacgagaaggugaagucccagcugaagaacaacgccaaggagaucggcaacgggugcuucgaguucuaccacaagugcaacgacgagugcauggagagcgucaagaacggcacguacgacuaccccaaguacuccgaggagagcaagcucaaccgcgagaagaucgacggcgugaagcuggaguccauggggguguaccagauccuggcgaucuacagcaccgucgccagcucccucgugcugcuggugagccucggcgccaucuccuucuggaugugcagcaacgggucccugcagugccggaucugcaucuga

SEQ ID NO: 63302 - RNA, 1689 nt, Artificial Sequence
  derived and/or modified sequence opt1 from hemagglutinin__InfluenzaA__ACD56324
auggccaucaucuaccugauccuccuguucaccgccgugcgcggcgaccagaucugcaucggguaccacgcgaacaacagcaccgagaaggucgacacgauccuggagcggaacgugaccgugacccacgccaagaacauccucgagaagacccacaacggccgccugugcaagcugaacgggaucccgccccucgagcugggcgacugcuccaucgccggguggcugcucggcaaccccgagugcgaccggcugcugcgcguccccgaguggagcuacaucauggagaaggagaacccccggaacggccucugcuacccgggguccuucaacgacuacgaggagcugaagcaccuccugagcuccgugaagcacuucgagaaggugcgcauccugcccaaggaccgguggacgcagcacaccaccaccggcagcucccgcgccugcgccgucagcgggaaccccuccuucuuccggaacaugguguggcugacgaagaaggagagcaacuaccccguggcgaagggcuccuacaacaacaccagcggggagcagaugcucaucaucuggggcguccaccacccgaucgacgagaccgagcagcgcacccuguaccagaacgugggcacguacguguccgucgggaccagcacccugaacaagcgguccacccccgacaucgccacgcgccccaaggugaacggccucgggagccggauggaguucuccuggacccugcuggacaugugggacaccaucaacuucgagagcaccggcaaccucaucgcccccgaguacggcuucaagaucuccaagcgcgggagcagcggcaucaugaagacggagcggacccuggagaacugcgagaccaagugccagaccccgcugggggccaucaacacgacccuccccuuccacaacgugcacccccugaccaucggcgagugccccaaguacgucaaguccgagaagcuggugcucgcgaccgggcugcgcaacgugccgcagaucgagccccggggccuguucggcgccaucgccggguucaucgagggcggguggcagggcauggucgacgggugguacggcuaccaccacagcaacgaccagggcuccggguacgccgccgacaaggagagcacgcagaaggcguucgacggcaucaccaacaaggugaacuccgugaucgagaagaugaacacccaguucgaggccgucgggaaggaguucagcaaccucgagcgccggcuggagaaccugaacaagaagauggaggacggcuuccucgacguguggaccuacaacgccgagcugcuggugcucauggagaacgagcgcacgcuggacuuccacgacuccaacgucaagaaccuguacgacaaggugcggaugcagcuccgcgacaacgucaaggagcuggggaacggcugcuucgaguucuaccacaagugcgacgacgagugcaugaacagcgugaagaacggcaccuacgacuaccccaaguacgaggaggaguccaagcugaaccgcaacgagaucaagggggugaagcucagcuccaugggcgucuaccagauccuggccaucuacgccaccguggcggggagccugucccucgccaucaugauggccggcaucagcuucuggaugugcuccaacggcagccugcagugccggaucugcaucuga

SEQ ID NO: 63303 - RNA, 1689 nt, Artificial Sequence
  derived and/or modified sequence opt1 from hemagglutinin__InfluenzaA__ACD85187
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagcuucaacgacuacgaggagcugaagcaccuccuguccagcgugaagcacuucgagaaggugaagauccugcccaaggaccgguggacgcagcacaccaccaccgggggcuccaaggccugcgccgucagcgggaagcccuccuucuuccgcaacaugguguggcugacgaagaagggccccaacuacccgguggcgaaggggagcuacaacaacaccuccggcgagcagaugcucaucaucuggggcguccaccaccccaaggacgaggccgagcagcgggcccuguaccaggagguggggaccuacgugagcgccuccaccagcacgcugaacaagcgcuccacccccgagaucgcggcccggcccgaggucaacggccucgggagccgcauggaguucuccuggacccugcuggacgugugggacaccaucaacuucgagagcacgggcaaccucguggccccggaguacggcuucaagaucuccaagcgggggagcagcggcaucaugaagaccgaggggacccugggcaacugcgagaccaagugccagacgccccugggggccaucaacaccacccuccccuuccacaacguccacccccugaccaucggcgagugcccgaaguacgugaaguccgagaagcuggugcucgccacgggccugcgcaacgucccccagaucgagagccgggggcuguucggcgcgaucgccggguucaucgagggcggguggcagggcaugguggacggcugguacggguaccaccacuccaacgaccagggcagcggguacgccgccgacaaggaguccacccagaaggccuucgacggcaucaccaacaaggugaacagcgucaucgagaagaugaacacccaguucgaggcgguggggaaggaguucaacaaccucgagaagcgccuggagaaccugaacaagaagauggaggacggcuuccucgacguguggacguacaacgccgagcugcugguccucauggagaacgagcggacccuggacuuccacgacuccaacgugaagaaccuguacgacaagguccgcaugcagcuccgggacaacgugaaggagcugggcaacgggugcuucgaguucuaccacaagugcgacgacgagugcaugaacagcgugaagaacggcaccuacgacuaccccaaguacgaggaggaguccaagcugaaccgcaacgagaucaagggggucaagcucagcuccaugggcguguaccagauccuggccaucuacgccaccguggccggcagccugucccucgcgaucaugauggccgggaucagcuucuggaugugcuccaacggcagccugcagugccggaucugcaucuga

SEQ ID NO: 63304 - RNA, 1689 nt, Artificial Sequence
  derived and/or modified sequence opt1 from hemagglutinin__InfluenzaA__ACD85198
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagcuucaacgacuacgaggagcugaagcaccuccuguccagcgugaagcacuucgagaaggugaagauccugcccaaggacggguggacgcagcacaccaccaccggcggguccaaggccugcgccgucagcggcaagcccuccuucuuccggaacaugguguggcugacgaagaaggggcccaacuacccgguggcgaagcgcagcuacaacaacaccuccggcgagcagaugcucaucaucuggggcguccaccaccccaccgacgaggccgagcagcgggcccuguaccaggagguggggaccuacgugagcgccuccacgagcacccugaacaagcgcuccacccccgagaucgcggcccggcccgaggucaacggccuccgcagccggauggaguucuccuggacccugcuggacgugugggacacgaucaacuucgagagcaccgggaaccucguggccccggaguacggcuucaagaucuccaagcgcggcagcagcgggaucaugaagaccgagggcacccuggggaacugcgagacgaagugccagacgccccugggcgccaucaacaccacccuccccuuccacaacguccacccccugaccaucggggagugcccgaaguacgugaaguccgagaagcuggugcucgccaccggccugcggaacgucccccagaucgagagccgcggccuguucggggcgaucgccggcuucaucgagggcggguggcaggggaugguggacggcugguacggcuaccaccacuccaacgaccaggggagcggcuacgccgccgacaaggaguccacccagaaggccuucgaccggaucaccaacaaggugaacagcgucaucgagaagaugaacacgcaguucgaggcgguggggaaggaguucuccaaccucgagaagcgccuggagaaccugaacaagaagauggaggacggcuuccucgacguguggaccuacaacgccgagcugcugguccucauggagaacgagcggacccugggguuccacgacagcaacgugaagaaccuguacgacaagguccgcaugcagcuccgggacaacgugaaggagcugggcaacggcugcuucgaguucuaccacaagugcgacgacgagugcaugaacuccgugaagaacgggaccuacgacuaccccaaguacgaggaggagagcaagcugaagcgcaacgagaucaagggcgucaagcucuccagcauggggguguaccagauccuggccaucuacgccacgguggccggcucccugagccucgcgaucaugauggccggcaucuccuucuggaugugcagcaacgggucccugcagugccggaucugcaucuga

SEQ ID NO: 63305 - RNA, 1689 nt, Artificial Sequence
  derived and/or modified sequence opt1 from hemagglutinin__InfluenzaA__ACD85209
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgcagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgacaucgccacgcggcccaaggugaacggccagggcgggcgcauggaguucagcuggacccuccuggacaugugggacaccaucaacuucgaguccaccggcaaccugaucgcccccgaguacggguucaagaucagcaagcggggcuccagcgggaucaugaagacggagggcacccucgagaacugcgagaccaagugccagaccccgcugggcgccaucaacacgacccugcccuuccacaacgugcacccccucaccaucggggagugccccaaguacgucaagagcgagaagcuggugcuggcgaccggccuccgcaacgugccgcagaucgagucccgggggcuguucggcgccaucgccggguucaucgagggcggcuggcaggggauggucgacggcugguacggguaccaccacagcaacgaccagggcuccggguacgccgccgacaaggagagcacgcagaaggcguucgacggcaucaccaacaaggugaacuccgugaucgagaagaugaacacccaguucgaggccgucggcaaggaguucagcaaccuggagcgccggcucgagaaccugaacaagaagauggaggacggguuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucggcaacgggugcuucgaguucuaccacaagugcgacgacgagugcaugaacagcgugaagaacggcaccuacgacuaccccaaguacgaggaggaguccaagcugaaccggaacgagaucaagggcgugaagcugagcuccaugggggucuaccagauccucgccaucuacgccaccguggcgggcagccugucccuggccaucaugauggccgggaucagcuucuggaugugcuccaacggcagccuccagugccgcaucugcaucuga

SEQ ID NO: 63306 - RNA, 1689 nt, Artificial Sequence
  derived and/or modified sequence opt1 from hemagglutinin__InfluenzaA__ACD85220
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaaccccaaguacucccucugcuacccgggcagcuucaacgacuacgaggagcugaagcaccuccuguccagcgugaagcacuucgagaaggugaagauccugcccaaggaccgcuggacgcagcacaccaccaccgggggcuccaaggccugcgccgucagcggggagcccuccuucuuccggaacaugguguggcugacgaagaagggccccaacuacccgguggcgaaggggagcuacaacaacaccuccggcgagcagaugcucaucaucuggggcguccaccaccccaaggacgaggccgagcagcgcgcccuguaccagaacguggggaccuacgugagcgccuccaccagcacgcugaacaagcgguccacccccgagaucgcggcccgccccgaggucaacggccucgggagccggauggaguucuccuggacccugcuggacgugugggacaccaucaacuucgagagcacgggcaaccucguggccccggaguacggcuucaagaucuccaagcgcgggagcagcggcaucaugaagaccgaggggacccugggcaacugcgagaccaagugccagacgccccugggggccaucaacaccacccuccccuuccacaacguccacccccugaccaucggcgagugcccgaaguacgugaaguccgagaagcuggugcucgccacgggccugcggaacgucccccagaucgagagccgcgggcuguucggcgcgaucgccggguucaucgagggcggguggcagggcaugguggacggcugguacggguaccaccacuccaacgaccagggcagcggguacgccgccgacaaggaguccacccagaaggccuucgacggcaucaccaacaaggugaacagcgucaucgagaagaugaacacccaguucgaggcgguggggaaggaguucaacaaccucgagaagcggcuggagaaccugaacaagaagauggaggacggcuuccucgacguguggacguacaacgccgagcugcugguccucauggagaacgagcgcacccuggacuuccacgacuccaacgugaagaaccuguacgacaagguccggaugcagcuccgcgacaacgugaaggagcugggcaacgggugcuucgaguucuaccacaagugcgacgacgagugcaugaacagcgugaagaacggcaccuacgacuaccccaaguacgagaaggaguccaagcugaaccggaacgagaucaagggggucaagcucagcuccaugggcguguaccagauccuggccaucuacgccaccguggccggcagccugucccucgcgaucaugauggccgggaucagcuucuggaugugcuccaacggcagccugcagugccgcaucugcaucuga

SEQ ID NO: 63307 - RNA, 1689 nt, Artificial Sequence
  derived and/or modified sequence opt1 from hemagglutinin__InfluenzaA__ACD85242
auggccaucaucuaccugauccuccuguucgccaccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagccugaacgacuacgaggagcugaagcaccuccuguccagcgugaagcacuucgagaaggugcggauccugcccaaggaccgcuggacgcagcacaccaccaccgggggcuccaaggccugcgccgucagcgggaagcccuccuucuuccggaacaugguguggcucacgaagaagggccccaacuacccgguggcgaaggggagcuacaacaacaccuccggcgagcagaugcugaucaucuggggcguccaccaccccaaggacgaggccgagcagcgcgcccuguaccaggagguggggaccuacgugagcgccuccaccagcacgcucaacaagcgguccauccccgagaucgcggcccgccccgaggucaacggccuggggagccggauggaguucuccuggacccugcucgacgugugggacaccaucaacuucgagagcaccggcaaccugguggccccggaguacggcuucaagaucuccaagcgcgggagcagcggcaucaugaagacggaggggacccugggcaacugcgagaccaagugccagacgccccucggggccaucaacaccacccugcccuuccacaacguccacccccugaccaucggcgagugcccgaaguacgugaaguccgagaagcucgugcuggccaccggccugcggaacgucccccagaucgagagccgcggccucuucggggcgaucgccggguucaucgagggcggguggcagggcaugguggacggcugguacggguaccaccacuccaacgaccagggcagcggguacgccgccgacaaggaguccacgcagaaggccuucgacggcaucaccaacaaggugaacagcaugaucgagaagaugaacacccaguucgaggcggucgggaaggaguucaacaaccuggagaagcggcuggagaaccucgacaagaagauggaggacggcuuccuggacguguggaccuacaacgccgagcugcucgugcugauggagaacgagcgcacgcuggacuuccacgacuccaacgucaagaaccucuacgagaaggugcggaugcagcugcgcgacaacgucaaggagcugggcaacgggugcuucgaguucuaccacaagugcgacaacgagugcaugaacagcgugaagaacggcaccuacgacuaccccaaguacgaggaggaguccaagcucaagcggaacgagaucaagggggugaagcugagcuccaugggcgucuaccagauccuggccaucuacgccaccguggccggcagccucucccuggcgaucaugguggccgggaucagcuucuggaugugcuccaacggcagccugcagugccgcaucugcaucuga

SEQ ID NO: 63308 - RNA, 1689 nt, Artificial Sequence
  derived and/or modified sequence opt1 from hemagglutinin__InfluenzaA__ACD85253
auggccaucaucuaccugauccuccuguucgccaccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacaaccucugcuacccgggcucccugaacgaguacgaggagcugaagcaccuccugagcuccgugaagcacuucgagaaggugcggauccugcccaaggaccgcuggacgcagcacaccaccaccgggggcagcaaggccugcgccgucuccggggagcccagcuucuuccggaacaugguguggcucacgaagaagggccccaacuacccgguggcgaagggguccuacaacaacaccagcggcgagcagaugcugaucaucuggggcguccaccaccccaacgacgaggccgagcagcgcgcccuguaccagaagguggggaccuacguguccgccagcaccuccacgcucaacaagcggagcauccccgagaucgcggcccgccccaaggucaacggccuggggucccggauggaguucuucuggacccugcucgacgugugggacaccaucaacuucgagagcaccggcaaccugguggucccggaguacggcuucaagaucuccaagcgcgggagcuccggcaucaugaagacggaggggacccugggcaacugcgagaccaagugccagacgccccucggggccaucaacaccacccugcccuuccacaacgugcacccccugaccaucggcgagugcccgaaguacgucaagagcgagaagcucgugcuggccaccggccugcggaacgugccccagaucgagagccgcggccucuucggggccaucgcgggguucaucgagggcggguggcagggcaugguggacggcugguacggguaccaccacuccaacgaccagggcagcggguacgccgccgacaaggaguccacgcagaaggccuucgacggcaucaccaacaaggucaacagcgugaucgagaagaugaacacccaguucgagaccguggggaaggaguucaacaaccuggagaagcggcuggagaaccucaacaagaagauggaggacggcuuccuggacgucuggacguacaacgccgagcugcucgugcugauggagaacgagcgcacccuggacuuccacgacuccaacgucaagaaccucuacgagaaggugcggaugcagcugcgcgacaacgugaaggagcugggcaacgggugcuucgaguucuaccacaagugcgacgacgagugcaugaacagcgucaagaacggcaccuacgacuaccccaaguacgaggaggaguccaagcucaagcggaacgagaucaagggggugaagcugagcuccaugggcguguaccagauccuggcgaucuacgccaccgucgccggcagccucucccuggccaucaugguggccgggaucagcuucuggaugugcuccaacggcagccugcagugccgcaucugcaucuga

SEQ ID NO: 63309 - RNA, 1701 nt, Artificial Sequence
  derived and/or modified sequence opt1 from hemagglutinin__InfluenzaA__ACD85440
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggaccucgggaacggcugcuucaagaucuaccacaagugcgacaacgcgugcaucggguccauccgcaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 63310 - RNA, 1701 nt, Artificial Sequence; identical to SEQ ID NO: 63309
  derived and/or modified sequence opt1 from hemagglutinin__InfluenzaA__ACD85451

SEQ ID NO: 63311 - RNA, 1701 nt, Artificial Sequence; identical to SEQ ID NO: 63309
  derived and/or modified sequence opt1 from hemagglutinin__InfluenzaA__ACD85462

SEQ ID NO: 63312 - RNA, 1701 nt, Artificial Sequence; identical to SEQ ID NO: 62936
  derived and/or modified sequence opt1 from hemagglutinin__InfluenzaA__ACD85473

SEQ ID NO: 63313 - RNA, 1701 nt, Artificial Sequence
  derived and/or modified sequence opt1 from hemagglutinin__InfluenzaA__ACD85484
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgaggaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 63314 - RNA, 1701 nt, Artificial Sequence; identical to SEQ ID NO: 62936
  derived and/or modified sequence opt1 from hemagglutinin__InfluenzaA__ACD85495

SEQ ID NO: 63315 - RNA, 1701 nt, Artificial Sequence
  derived and/or modified sequence opt1 from hemagglutinin__InfluenzaA__ACD85528
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgucagccugcggucccucguggcgagcuccggcacgcuggaguucaacaacgagagcuucaacuggaccggggugacccagaacggcaccuccagcgccugcauccgccgguccaacaagagcuucuucucccgccugaacuggcucacgcaccugaaguucaaguaccccgcccugaacgucaccaugcccaacaacgagaacuucgacaagcucuacaucuggggcgugcaccaccccgggaccgacaacgaccagaucuuccuguacgcccaggcgagcgggcggaucaccguguccacgaagcgcagccagcagaccgucaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgcgaucgccggguucaucgagaacggcugggagggcauggucgacgggugguacggcuuccgccaccagaacagcgaggggaucggccaggccgccgaccugaaguccacccaggccgcgaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgggagaacgccgaggaccucgggaacggcugcuucaagaucuaccacaagugcgacaacgccugcaucggguccauccgcaacggcaccuacgaccacgacguguaccgcgacgaggcgcugaacaaccgguuccagaucaaggggguggagcugaaguccggcuacaaggacuggauccucuggaucuccuucgccaucagcugcuuccugcugugcgucgcccuccugggcuucaucaugugggccugccagaaggggaacauccgcugcaacaucugcaucuga

SEQ ID NO: 63316 - RNA, 1701 nt, Artificial Sequence
  derived and/or modified sequence opt1 from hemagglutinin__InfluenzaA__ACD85539
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccggacgaacaacuccuucuucagccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucacggugagcaccaagcgcucccagcagaccgugaucccgaacaucggcagccggccccgcguccggaacauccccagccgcaucuccaucuacuggaccaucgugaagcccggcgacauccugcucaucaacagcacggggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcacguacgaccacgacgucuaccgcgacgaggcccucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 63317 - RNA, 1701 nt, Artificial Sequence
  derived and/or modified sequence opt1 from hemagglutinin__InfluenzaA__ACD85550
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggaccucgggaacggcugcuucaagaucuaccacaagugcgacaacgcgugcaucggguccauccgcaacggcaccuacgaccacgacgucuaccgcgacgaggcccugaacaaccgguuccagaucaaggggguggagcugaaguccggcuacaaggacuggauccucuggaucuccuucgccaugagcugcuuccugcugugcguggcccuccugggcuucaucaugugggccugccagaaggggaacauccgcugcaacaucugcaucuga

SEQ ID NO: 63318 - RNA, 1701 nt, Artificial Sequence; identical to SEQ ID NO: 62936
  derived and/or modified sequence opt1 from hemagglutinin__InfluenzaA__ACD85561

SEQ ID NO: 63319 - RNA, 1701 nt, Artificial Sequence
  derived and/or modified sequence opt1 from hemagglutinin__InfluenzaA__ACD85572
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaccggcagccggccccgcguccggaacauccccucccgcaucagcaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 63320 - RNA, 1701 nt, Artificial Sequence; identical to SEQ ID NO: 63316
  derived and/or modified sequence opt1 from hemagglutinin__InfluenzaA__ACD85583

SEQ ID NO: 63321 - RNA, 1701 nt, Artificial Sequence
  derived and/or modified sequence opt1 from hemagglutinin__InfluenzaA__ACD93579
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacacgugcaucggguccauccgcaacggcaccuacgaccacgacgucuaccgcgacgaggcgcucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 63322 - RNA, 1701 nt, Artificial Sequence; identical to SEQ ID NO: 61638
  derived and/or modified sequence opt1 from hemagglutinin__InfluenzaA__ACF09402

SEQ ID NO: 63323 - RNA, 1701 nt, Artificial Sequence
  derived and/or modified sequence opt1 from hemagglutinin__InfluenzaA__ACF22159
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaacagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccgccugcaagcgccggagcaacaaguccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcgcaggccuccggccggaucaccgugagcacgaagcgcagccagcagaccgugaucccgaacaucggcuuccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccucaagagcacccaggcggccaucaaccagaucaacggcaagcugaaccggcugaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucgagagcauccgcaacggcacguacgaccacgacguguaccgggacgaggcccucaacaaccgcuuccagaucaaggggguggagcugaaguccggcuacaaggacuggauccuguggaucagcuucgccaucuccugcuuccuccugugcgucgcccugcucggcuucaucaugugggccugccagaaggggaacauccggugcaacaucugcaucuga

SEQ ID NO: 63324 - RNA, 1701 nt, Artificial Sequence
  derived and/or modified sequence opt1 from hemagglutinin__InfluenzaA__ACF22188
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucuggagccgccccugggugcggggccuguccagccgcaucuccaucuacuggaccaucgucaagcccggcgacgugcucgugaucaacagcaacgggaaccugaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaacuacgaccacgacguguaccgcgacgaggcccucaacaaccgguuccagaucaagggcgucgagcucaagagcggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 63325 - RNA, 1701 nt, Artificial Sequence; identical to SEQ ID NO: 63324
  derived and/or modified sequence opt1 from hemagglutinin__InfluenzaA__ACF22199

SEQ ID NO: 63326 - RNA, 1701 nt, Artificial Sequence
  derived and/or modified sequence opt1 from hemagglutinin__InfluenzaA__ACF22210
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagagcggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 63327 - RNA, 1701 nt, Artificial Sequence; identical to SEQ ID NO: 63326
  derived and/or modified sequence opt1 from hemagglutinin__InfluenzaA__ACF22221

SEQ ID NO: 63328 - RNA, 1701 nt, Artificial Sequence; identical to SEQ ID NO: 63326
  derived and/or modified sequence opt1 from hemagglutinin__InfluenzaA__ACF22232

SEQ ID NO: 63329 - RNA, 1701 nt, Artificial Sequence; identical to SEQ ID NO: 63326
  derived and/or modified sequence opt1 from hemagglutinin__InfluenzaA__ACF22243

SEQ ID NO: 63330 - RNA, 1701 nt, Artificial Sequence; identical to SEQ ID NO: 63326
  derived and/or modified sequence opt1 from hemagglutinin__InfluenzaA__ACF22254

SEQ ID NO: 63331 - RNA, 1701 nt, Artificial Sequence; identical to SEQ ID NO: 63326
  derived and/or modified sequence opt1 from hemagglutinin__InfluenzaA__ACF22265

SEQ ID NO: 63332 - RNA, 1701 nt, Artificial Sequence; identical to SEQ ID NO: 63326
  derived and/or modified sequence opt1 from hemagglutinin__InfluenzaA__ACF22276

SEQ ID NO: 63333 - RNA, 1701 nt, Artificial Sequence; identical to SEQ ID NO: 63326
  derived and/or modified sequence opt1 from hemagglutinin__InfluenzaA__ACF22287

SEQ ID NO: 63334 - RNA, 1701 nt, Artificial Sequence; identical to SEQ ID NO: 63326
  derived and/or modified sequence opt1 from hemagglutinin__InfluenzaA__ACF22298

SEQ ID NO: 63335 - RNA, 1701 nt, Artificial Sequence; identical to SEQ ID NO: 63326
  derived and/or modified sequence opt1 from hemagglutinin__InfluenzaA__ACF22320

SEQ ID NO: 63336 - RNA, 1701 nt, Artificial Sequence; identical to SEQ ID NO: 63326
  derived and/or modified sequence opt1 from hemagglutinin__InfluenzaA__ACF22342

SEQ ID NO: 63337 - RNA, 1701 nt, Artificial Sequence
  derived and/or modified sequence opt1 from hemagglutinin__InfluenzaA__ACF22364
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucgagagccgccccugggugcggggccuguccagccgcaucuccaucuacuggaccaucgucaagcccggcgacgugcucgugaucaacagcaacgggaaccugaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaagggcgucgagcucaagagcggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 63338 - RNA, 1701 nt, Artificial Sequence; identical to SEQ ID NO: 63316
  derived and/or modified sequence opt1 from hemagglutinin__InfluenzaA__ACF22408

SEQ ID NO: 63339 - RNA, 1701 nt, Artificial Sequence; identical to SEQ ID NO: 62936
  derived and/or modified sequence opt1 from hemagglutinin__InfluenzaA__ACF41669

SEQ ID NO: 63340 - RNA, 1698 nt, Artificial Sequence; identical to SEQ ID NO: 62922
  derived and/or modified sequence opt1 from hemagglutinin__InfluenzaA__ACF41680

SEQ ID NO: 63341 - RNA, 1689 nt, Artificial Sequence
  derived and/or modified sequence opt1 from hemagglutinin__InfluenzaA__ACF41691
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagcuucaacgacuacgaggagcugaagcaccuccuguccagcgugaagcacuucgagaaggugaagauccugcccaaggacggguggacgcagcacgagaccgacggcggguccaaggccugcgccgucagcggcaagcccuccuucuuccggaacaugguguggcugaccaagaaggggcccaacuacccgguggcgaagcgcagcuacaacaacaccuccggcgagcagaugcucaucaucuggggcguccaccaccccaacgacgaggccgagcagcgggcccuguaccaggagguggggacguacgugagcgccuccaccagcacccugaacaagcgcuccacccccgagaucgcggcccggcccaaggucagcggccucgggucccgcauggaguucagcuggacgcugcuggacgugugggacaccaucuccuucgagagcaccggcaaccucguggccccggaguacggcuucaagaucagcaagcggggguccagcggcaucaugaagaccgaggggacgcugggcaacugcgagaccaagugccagacgccccugggggccaucaacaccacccuccccuuccacaacguccacccccugaccaucggcgagugcccgaaguacgugaaguccgagaagcuggugcucgccaccggccugcgcaacgucccccagaucgagagccgggggcuguucggcgcgaucgccggguucaucgagggcggguggcagggcaugguggacggcugguacggguaccaccacuccaacgaccagggcagcggguacgccgccgacaaggaguccacccagaaggccuucgaccgcaucacgaacaaggugaacagcgucaucgagaagaugaacacccaguucgaggcggugggcaaggaguucuccaaccucgagaagcggcuggagaaccugaacaagaagauggaggacggguuccucgacguguggaccuacaacgccgagcugcugguccucauggagaacgagcgcacccuggacuuccacgacagcaacgugaagaaccuguacgacaagguccggaugcagcuccgcgacaacgugaaggagcugggcaacggcugcuucgaguucuaccacaagugcgacgacgagugcaugaacuccgugaagaacgggacguacgacuaccccaaguacgaggaggagagcaagcugaagcggaacgagaucaagggcgucgagcucuccagcauggggguguaccagauccuggccaucuacgccaccguggccggcucccugagccucgcgaucaugaucgccggcaucuccuucuggaugugcagcaacgggucccugcagugccgcaucugcaucuga

SEQ ID NO: 63342 - RNA, 1701 nt, Artificial Sequence; identical to SEQ ID NO: 63324
  derived and/or modified sequence opt1 from hemagglutinin__InfluenzaA__ACF41735

SEQ ID NO: 63343 - RNA, 1701 nt, Artificial Sequence
  derived and/or modified sequence opt1 from hemagglutinin__InfluenzaA__ACF41790
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgaggacuucaccuggacgggggugacccagaacggcggguccaacgccugcaagcggggccccgggagcggcuucuucucccgccucaacuggcugaccaagagcggcuccaccuaccccgugcuggacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucgggagccgccccugggugcggggccuguccagccgcaucuccaucuacuggaccaucgucaagcccggcgacgugcucgugaucaacagcaacgggaaccugaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaagggcgucgagcucaagagcggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 63344 - RNA, 1701 nt, Artificial Sequence
  derived and/or modified sequence opt1 from hemagglutinin__InfluenzaA__ACF41823
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccgccagaccaucauccccaacaucggcagccggcccugggugcgcggccuguccagccggaucuccaucuacuggaccaucgucaagcccggggacgugcucgugaucaacagcaacggcaaccugaucgcgccgcgcggguacuucaagaugcggaccggcaaguccagcaucaugcgcuccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcggaacgugcccgagaagcagacccgcgggcuguucggcgccaucgcgggguucaucgagaacggcugggaggggaugaucgacggcugguacggcuuccggcaccagaacagcgaggggaccggccaggccgccgaccugaaguccacccaggccgccaucgaccagaucaacgggaagcucaaccgcgucaucgagaagacgaacgagaaguuccaccagaucgagaaggaguucagcgagguggagggccggauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcgccggcagcugcgcgagaacgccgaggacauggggaacggcugcuucaagaucuaccacaagugcgacaacgccugcaucgaguccauccgcaacggcaccuacgaccacaacguguaccgggacgaggcccucaacaaccgcuuccagaucaagggggucgagcucaagagcggcuacaaggacuggauccuguggaucuccuucgcgaucagcugcuuccugcugugcguggugcugcucggguucaucaugugggccugccagcggggcaacauccgcugcaacaucugcaucuga

SEQ ID NO: 63345 - RNA, 1698 nt, Artificial Sequence
  derived and/or modified sequence opt1 from hemagglutinin__InfluenzaA__ACF41834
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaaccugaagaacagcuacgucaacaagaagggcaaggaggugcucgugcugugggggauccaccacccguccaacagcaaggagcagcagaaccuguaccagaacgagaacgcguacgucuccguggugacgagcaacuacaaccggcgcuucacccccgagaucgccgagcggcccaagguccgcgaccaggccggccggaugaacuacuacuggacccuccugaagcccggcgacaccaucaucuucgaggccaacgggaaccugaucgccccgauguacgcguucgcccucagccgcggcuucggguccggcaucaucacgagcaacgccuccaugcacgagugcaacaccaagugccagacgccccugggcgccaucaacagcucccugcccuaccagaacauccaccccgugaccaucggggagugcccgaaguacgugcggagcgccaagcuccgcauggucaccggccugcggaacauccccuccauccagagccgcgggcuguucggcgcgaucgccggguucaucgagggcggcuggaccgggaugaucgacggcugguacggguaccaccaccagaacgagcagggcuccggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggucaagagccagcucaagaacaacgccaaggagaucggcaacgggugcuucgaguucuaccacaagugcgacaacgagugcauggaguccgugcggaacggcacguacgacuaccccaaguacagcgaggaguccaagcugaaccgcgagaagguggacggggugaagcuggagagcaugggcaucuaccagauccucgccaucuacuccaccgucgccagcucccuggugcugcucgugagccugggcgcgaucagcuucuggaugugcuccaacgggagccugcagugccggaucugcaucuga

SEQ ID NO: 63346 - RNA, 1701 nt, Artificial Sequence
  derived and/or modified sequence opt1 from hemagglutinin__InfluenzaA__ACF41856
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccaggacggcgggagcuacgccugcaagcgcggcuccgugaacagcuucuucucccggcucaacuggcugcacaagagcgaguacaaguaccccgcgcugaacgucaccaugcccaacaacgggaaguucgacaagcucuacaucuggggcgugcaccaccccuccaccgaccgcgaccagacgagccuguacgugcgggccuccggccgcgucaccgugagcaccaagcggagccagcagaccgugacgccgaacaucgggucccgccccuggguccggggccagagcucccgcaucagcaucuacuggaccaucgugaagcccggggacauccugcucaucaacuccaccggcaaccugaucgcgccccggggcuacuucaagauccgcaacggcaagagcuccaucaugcggagcgacgccccgaucgggaccugcuccagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgggagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 63347 - RNA, 1698 nt, Artificial Sequence
  derived and/or modified sequence opt1 from hemagglutinin__InfluenzaA__ACF41867
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgugaccggggucaccgccagcugcucccacaacggcaagagcuccuucuaccgcaaccuccuguggcugacggagaagaacgggcucuaccccaaccugagcaacuccuacgugaacaacaaggagaaggaggugcugguccucuggggcgugcaccaccccagcaacauccgggaccagcgcgccaucuaccacaccgagaacgccuacgugagcgucguguccagccacuacucccggcgcuucaccccggagaucgccaagcggcccaaggugcgcgggcaggagggccggaucaacuacuacuggacccugcuggagcccggcgacacgaucaucuucgaggcgaacgggaaccucaucgcccccugguacgccuucgcccugagccgcggcuucggguccggcaucaucaccagcaacgccccgaugaacgagugcgacgcgaagugccagacgccccagggcgccaucaacuccagccugcccuuccagaacguccaccccgugaccaucggggagugcccgaaguacgugcgguccaccaagcuccgcauggucaccggccugcggaacauccccagcauccagucccgcgggcuguucggcgccaucgccggguucaucgagggcggcuggaccgggaugauggacggcugguacggguaccaccaccagaacgagcagggcagcggguacgccgcggaccagaaguccacccagaacgccaucaacggcaucacgaacaaggugaacagcgugaucgagaagaugaacacccaguucaccgccgucggcaaggaguucaacaagcucgagcggcgcauggagaaccugaacaagaagguggacgacggguuccuggacaucuggaccuacaacgccgagcuccugguccugcucgagaacgagcggacgcuggacuuccacgacuccaacgugaagaaccuguacgagaaggucaagagccagcucaagaacaacgccaaggagaucggcaacgggugcuucgaguucuaccacaagugcaacaacgagugcauggaguccgugaagaacggcaccuacgacuaccccaaguacagcgaggaguccaagcugaaccgcgagaagaucgacggggugaagcuggagagcaugggcguguaccagauccucgcgaucuacagcaccgucgccuccagccuggugcugcucgugucccugggcgccaucagcuucuggaugugcuccaacgggagccugcagugccggaucugcaucuga

SEQ ID NO: 63348 - RNA, 1698 nt, Artificial Sequence; identical to SEQ ID NO: 63123
  derived and/or modified sequence opt1 from hemagglutinin__InfluenzaA__ACF41878

SEQ ID NO: 63349 - RNA, 1701 nt, Artificial Sequence
  derived and/or modified sequence opt1 from hemagglutinin__InfluenzaA__ACF41922
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccguggccggcuggauccuggggaacccgaagugcgagagccuguucuccaaggagagcugguccuacaucgccgagacccccaaccccgagaacgggaccugcuaccccggcuacuucgccgacuacgaggagcuccgggagcagcugagcuccgucagcuccuucgagcgcuucgagaucuucccgaaggagagcuccuggcccaaccacacggugaccaagggggugaccgccagcugcucccacaacggcaagagcuccuucuaccggaaccugcucuggcugaccgagaagaacgggcuguaccccaaccucagcaaguccuacgucaacaacaaggagaaggaggugcuggugcuguggggcguccaccaccccagcaacauccgcgaccagcgggccaucuaccacacggagaacgcguacgugagcguggucuccagccacuacucccgccgguucaccccggagaucgccaagcgccccaaggugcgggaccaggaggggcgcaucaacuacuacuggacccuccuggagcccggcgacaccaucaucuucgaggccaacggcaaccugaucgcccccugguacgccuucgcgcucagccggggguucggcuccgggaucaucacgagcaacgccuccauggacgagugcgacgccaagugccagaccccgcagggcgccaucaacagcucccugcccuuccagaacgugcaccccgucaccaucggcgagugccccaaguacgugcgcagcaccaagcugcggauggugacggggcuccgcaacaucccguccauccagagccggggccuguucggggccaucgcgggcuucaucgagggcggcuggaccggcaugaucgacgggugguacggcuaccaccaccagaacgagcagggguccggcuacgccgccgaccagaaguccacccagaacgccaucaacgggaucaccaacaaggucaacagcgugaucgagaagaugaacacgcaguucaccgccgugggcaaggaguucaacaagcuggagcgccggauggagaaccucaacaagaaggucgacgacggcuuccuggacaucuggaccuacaacgcggagcugcucgugcugcuggagaacgggcgcacccucgacuuccacgacagcaacgucaagaaccuguacgagaaggugaagucccagcugaagaacaacgccaaggagaucggcaacgggugcuucgaguucuaccacaagugcaacaacgagugcauggagagcgugaagaacggcacguacgacuaccccaaguacuccgaggagagcaagcucaaccgggggaagaucgacggcgucaagcuggagagcaugggcguguaccagauccuggccaucuacuccaccguggccagcucccucguccugcuggugagccucggggccaucuccuucuggaugugcagcaacggcucccugcagugccgcaucugcaucuga

SEQ ID NO: 63350 - RNA, 1689 nt, Artificial Sequence
  derived and/or modified sequence opt1 from hemagglutinin__InfluenzaA__ACF54389
auggccaucaucuaccugauccuccuguucgccaccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaacccccgcuacucccucugcuacccgggcagccugaacgacuacgaggagcugaagcaccuccuguccagcgugaagcacuucgagaaggugcggauccugcccaaggaccgcuggacgcagcacaccaccaccgggggcuccaaggccugcgccgucagcgggaagcccuccuucuuccggaacaugguguggcucacgaagaagggcaccaacuaccccguggcgaaggggagcuacaacaacaccuccggcgagcagaugcugaucaucuggggcguccaccacccgaucgacgaggccgagcagcgcgcccuguaccaggagguggggaccuacgugagcgccuccacgagcacccucaacaagcgguccauccccgagaucgcggcccgccccgaggucaacggccuggggagccggauggaguucuccuggacccugcucgacgugugggacaccaucaacuucgagagcacgggcaaccugguggcccccgaguacggcuucaagaucuccaagcgcgggagcagcggcaucaugaagaccgaggggacccugggcaacugcgagaccaagugccagacgccgcucggggccaucaacaccacccugcccuuccacaacguccacccccugaccaucggcgagugccccaaguacgugaaguccgagaagcucgugcuggccacgggccugcggaacgucccgcagaucgagagccgcggccucuucggggcgaucgccggguucaucgagggcggguggcagggcaugguggacggcugguacggguaccaccacuccaacgagcagggcagcggguacgccgccgacaaggaguccacccagaaggccuucgacggcaucaccaacaaggugaacagcgucaucgagaagaugaacacccaguucgaggcgguggggaaggaguucaacaaccuggagaagcggcuggagaaccucaacaagaagauggaggacggcuuccuggacguguggacguacaacgccgagcugcucguccugauggagaacgagcgcacccuggacuuccacgacuccaacgugaagaaccucuacgagaagguccggaugcagcugcgcgacaacgugaaggagcugggcaacgggugcuucgaguucuaccacaagugcgacgacgagugcaugaacagcgugaagaacggcaccuacgacuaccccaaguacgaggaggaguccaagcucaagcggaacgagaucaagggggucaagcugagcuccaugggcguguaccagauccuggccaucuacgccaccguggccggcagccucucccuggcgaucauggucgccgggaucagcuucuggaugugcuccaacggcagccugcagugccgcaucugcaucuga

SEQ ID NO: 63351 - RNA, 1701 nt, Artificial Sequence; identical to SEQ ID NO: 63324
  derived and/or modified sequence opt1 from hemagglutinin__InfluenzaA__ACF54400

SEQ ID NO: 63352 - RNA, 1701 nt, Artificial Sequence; identical to SEQ ID NO: 63326
  derived and/or modified sequence opt1 from hemagglutinin__InfluenzaA__ACF54411

SEQ ID NO: 63353 - RNA, 1701 nt, Artificial Sequence; identical to SEQ ID NO: 63326
  derived and/or modified sequence opt1 from hemagglutinin__InfluenzaA__ACF54422

SEQ ID NO: 63354 - RNA, 1701 nt, Artificial Sequence; identical to SEQ ID NO: 63337
  derived and/or modified sequence opt1 from hemagglutinin__InfluenzaA__ACF54433

SEQ ID NO: 63355 - RNA, 1701 nt, Artificial Sequence; identical to SEQ ID NO: 63326
  derived and/or modified sequence opt1 from hemagglutinin__InfluenzaA__ACF54444

SEQ ID NO: 63356 - RNA, 1701 nt, Artificial Sequence; identical to SEQ ID NO: 63344
  derived and/or modified sequence opt1 from hemagglutinin__InfluenzaA__ACF54466

SEQ ID NO: 63357 - RNA, 1689 nt, Artificial Sequence
  derived and/or modified sequence opt1 from hemagglutinin__InfluenzaA__ACF54477
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgacaucgccacgcggcccaaggugaacggccucggcagccgcauggaguucuccuggacccugcuggacaugugggacaccaucaacuucgagagcaccgggaaccucaucgcccccgaguacggcuucaagaucuccaagcgggggagcagcggcaucaugaagacggaggggacccuggagaacugcgagaccaagugccagaccccgcugggcgccaucaacacgacccuccccuuccacaacgugcacccccugaccaucggcgagugccccaaguacgucaaguccgagaagcuggugcucgcgaccgggcugcgcaacgugccgcagaucgagagccggggccuguucggggccaucgccggcuucaucgagggcggguggcagggcauggucgacgggugguacggcuaccaccacuccaacgaccaggggagcggcuacgccgccgacaaggaguccacgcagaaggcguucgacgggaucaccaacaaggugaacagcgugaucgagaagaugaacacccaguucgaggccgucggcaaggaguucuccaaccucgagcgccggcuggagaaccugaacaagaagauggaggacggcuuccucgacguguggaccuacaacgccgagcugcuggugcucauggagaacgagcgcacgcuggacuuccacgacagcaacgucaagaaccuguacgacaaggugcggaugcagcuccgcgacaacgucaaggagcuggggaacggcugcuucgaguucuaccacaagugcgacgacgagugcaugaacuccgugaagaacgggaccuacgacuaccccaaguacgaggaggagagcaagcugaaccggaacgagaucaagggcgugaagcucuccagcaugggcgucuaccagauccuggccaucuacgccaccguggcggggucccugagccucgccaucaugauggccggcaucuccuucuggaugugcagcaacgggucccugcagugccgcaucugcaucuga

SEQ ID NO: 63358 - RNA, 1689 nt, Artificial Sequence
  derived and/or modified sequence opt1 from hemagglutinin__InfluenzaA__ACF54499
auggccaucaucuaccugauccuccuguucaccgccgugcgcggcgaccagaucugcaucggguaccacgcgaacaacagcaccgagacggucgacaccauccuggagcggaacgugaccgugacccacgccaaggacauccucgagaagacgcacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacccagcacaccaccacgggcgggucccgggccugcgccgucagcggcaaccccuccuucuuccgcaacaugguguggcugaccaagaaggggagcaacuaccccguggcgaagggcuccuacaacaacaccagcggcgagcagaugcucaucaucuggggcguccaccacccgaacgacgagaccgagcagcggacgcuguaccagaacguggggaccuacguguccgucgggaccagcacccugaacaagcgcuccacgcccgacaucgccacccggcccaaggugaacggccucggcagccgcauggaguucuccuggacccugcuggacaugugggacaccaucaacuucgagagcacggggaaccucaucgcccccgaguacggcuucaagaucuccaagcgggggagcagcggcaucaugaagaccgaggggacccuggagaacugcgagaccaagugccagacgccgcugggcgccaucaacaccacccuccccuuccacaacgugcacccccugaccaucggcgagugccccaaguacgucaaguccgagaagcuggugcucgcgacggggcugcgcaacgugccgcagaucgagagccggggccuguucggggccaucgccggcuucaucgagggcggguggcagggcauggucgacgggugguacggcuaccaccacuccaacgaccaggggagcggcuacgccgccgacaaggaguccacccagaaggcguucgacgggaucaccaacaaggugaacagcgugaucgagaagaugaacacccaguucgaggccgucggcaaggaguucuccaaccucgagcgccggcuggagaaccugaacaagaagauggaggacggcuuccucgacguguggacguacaacgccgagcugcuggugcucauggagaacgagcgcacccuggacuuccacgacagcaacgucaagaaccuguacgacaaggugcggaugcagcuccgcgacaacgucaaggagcuggggaacggcugcuucgaguucuaccacaagugcgacgacgagugcaugaacuccgugaagaacgggaccuacgacuaccccaaguacgaggaggagagcaagcugaaccggaacgagaucaagggcgugaagcucuccagcaugggcgucuaccagauccuggccaucuacgccaccguggcggggucccugagccucgccaucaugauggccggcaucuccuucuggaugugcagcaacgggucccugcagugccgcaucugcaucuga

SEQ ID NO: 63359 - RNA, 1689 nt, Artificial Sequence; identical to SEQ ID NO: 63358
  derived and/or modified sequence opt1 from hemagglutinin__InfluenzaA__ACF54510

SEQ ID NO: 63360 - RNA, 1689 nt, Artificial Sequence; identical to SEQ ID NO: 63358
  derived and/or modified sequence opt1 from hemagglutinin__InfluenzaA__ACF54521

SEQ ID NO: 63361 - RNA, 1701 nt, Artificial Sequence
  derived and/or modified sequence opt1 from hemagglutinin__InfluenzaA__ACF54532
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugacgagcggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 63362 - RNA, 1701 nt, Artificial Sequence
  derived and/or modified sequence opt1 from hemagglutinin__InfluenzaA__ACF54543
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgucagccugcggucccucguggcgagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgucaccaugcccaacaacgagaacuucgacaagcucuacaucuggggcgugcaccaccccgggaccgacaacgaccagaucuuccuguacgcccaggcgagcgggcggaucaccguguccacgaagcgcagccagcagaccgucaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgccaccggcaugcgcaacgugcccgagaagcagacgcgggggaucuucggcgcgaucgccggguucaucgagaacggcugggagggcauggucgacgggugguacggcuuccgccaccagaacagcgaggggaucggccaggccgccgaccugaaguccacccaggccgcgaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgggagaacgccgaggaccucgggaacggcugcuucaagaucuaccacaagugcgacaacgccugcaucggguccauccgcaacggcaccuacgaccacgacguguaccgcgacgaggcgcugaacaaccgguuccagaucaaggggguggagcugaaguccggcuacaaggacuggauccucuggaucuccuucgccaucagcugcuuccugcugugcgucgcccuccugggcuucaucaugugggccugccagaaggggaacauccgcugcaacaucugcaucuga

SEQ ID NO: 63363 - RNA, 1701 nt, Artificial Sequence
  derived and/or modified sequence opt1 from hemagglutinin__InfluenzaA__ACF54565
augaagaccaucaucgcccugagcuacauccucugccugguguucucccagaagcugcccggcaacgacaacagcaccgccacgcucugccuggggcaccacgcggucccgaacggcaccaucgugaagaccaucaccaacgaccagaucgaggugacgaacgccaccgagcugguccaguccagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgccucccugcggagccucgucgcguccagcgggacgcuggaguucaacaacgaguccuucaacugggccggcgugacccagaacgggaccagcuccgccugcaagcgccggagcaacaaguccuucuucagccgccugaacuggcucacccaccugaaguacaaguaccccgcccugaacgugacgaugcccaacaacgagaaguucgacaagcucuacaucuggggcguccaccaccccgugaccgacuccgaccagaucagccuguacgcgcaggccagcgggcggaucaccguguccaccaagcgcagccagcagacggucaucccgaacaucggcuaccggccccgcgugcgggacaucuccagccgcaucuccaucuacuggaccaucgugaagcccggcgacauccugcucaucaacagcaccgggaaccugaucgcgccccggggcuacuucaagauccgcuccggcaagagcuccaucaugcggagcgacgccccgaucgggaagugcaacuccgagugcaucacccccaacggcagcauccccaacgacaagcccuuccagaacgucaaccgcaucacguacggggccugcccgcgguacgugaagcagaacacccugaagcucgccaccggcaugcgcaacgugcccgagaagcagacccgggggaucuucggcgccaucgccggguucaucgagaacggcugggagggcauggucgacgggugguacggcuuccgccaccagaacuccgaggggacgggccaggccgccgaccucaagagcacccaggcggccaucaaccagaucaacgggaagcugaaccggcugaucggcaagaccaacgagaaguuccaccagaucgagaaggaguucuccgagguggagggccgcauccaggaccuggagaaguacguggaggacaccaagaucgaccuguggagcuacaacgccgagcuccuggucgcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgcgugcaucgagagcauccgcaacgggaccuacgaccacgacguguaccgggacgaggcccucaacaaccgcuuccagaucaagggcguggagcugaaguccggguacaaggacuggauccuguggaucagcuucgccaucagcugcuuccuccugugcgucgcccugcucggcuucaucaugugggccugccagaagggcaacauccggugcaacaucugcaucuga

SEQ ID NO: 63364 - RNA, 1701 nt, Artificial Sequence
  derived and/or modified sequence opt1 from hemagglutinin__InfluenzaA__ACF54576
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacgacgagagcuucaacuggaccggcgugacccagaacgggaccuccagcuccugcaagcgccggagcaacaacuccuucuucagccgccugaacuggcucacgcagcugaaguucaaguaccccgcccugaacgugaccaugcccaacaacgagaaguucgacaagcucuacaucuggggcguccaccaccccgugaccgacaacgaccagaucuuccuguacgcccaggcguccgggcggaucaccgugagcacgaagcgcagccagcagaccgucaucccgaacaucggcucccggccccgcauccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgccaccggcaugcgcaacgugcccgagaagcagacgcgggggaucuucggcgcgaucgccggguucaucgagaacggcugggagggcaugguggacgggugguacggcuuccgccaccagaacuccgaggggaucggccaggccgccgaccucaagagcacccaggccgcgaucaaccagaucaacgggaagcugaaccggcugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacauggggaacggcugcuucaagaucuaccacaagugcgacaacgccugcaucgggagcauccgcaacggcaccuacgaccacgacgucuaccgggacgaggcgcucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 63365 - RNA, 1698 nt, Artificial Sequence
  derived and/or modified sequence opt1 from hemagglutinin__InfluenzaA__ACF54598
augaaggccaagcugcucgugcugcuguacgccuucgucgcgaccgacgccgacaccaucugcaucggcuaccacgccaacaacagcacggacaccguggacaccaucuucgagaagaacguggccgucacccacuccgugaaccuccuggaggaccgccacaacgggaagcugugcaagcucaagggcaucgcgccccugcagcuggggaagugcaacaucaucggcuggcuccuggggaacccggagugcgacagccugcuccccgcccgguccuggagcuacaucguggagacgcccaacuccgagaacggcgccugcuaccccggcgacuucaucgacuacgaggagcugcgcgagcagcugagcuccgucagcucccucgagcgguucgagaucuucccgaaggagagcuccuggcccaaccacaccuucaacggggugaccgccagcugcucccaccgcggcaagagcuccuucuaccggaaccugcuguggcucaccaagaagggggacagcuaccccaagcugacgaacuccuacgugaacaacaagggcaaggagguccuggugcucuggggcgugcaccaccccagcuccagcgacgagcagcagagccuguacuccaacgggaacgccuacgucagcguggcguccagcaacuacaaccgccgguucaccccggagaucgccgcccgccccaaggugaaggaccagcacggccggaugaacuacuacuggacccugcucgagcccggggacaccaucaucuucgaggccacgggcaaccugaucgcccccugguacgcguucgcccugucccgcggguucgagagcggcaucaucaccuccaacgccagcaugcacgagugcaacaccaagugccagaccccgcagggcuccaucaacagcaaccuccccuuccagaacauccaccccgucacgaucggggagugccccaaguacgugcgguccaccaagcugcgcauggugaccggccugcggaacaucccgagcauccaguaccgcggccucuucggggccaucgccggguucaucgagggcggcuggaccgggaugaucgacggcugguacggguaccaccaccagaacgagcagggcuccggguacgcggccgaccagaaguccacgcagaacgccaucaacggcaucaccaacaaggucaacagcaucaucgagaagaugaacacccaguucaccgccgugggcaaggaguucaacaaccuggagaagcggauggagaaccugaacaagaagguggacgacggguuccucgacaucuggacguacaacgccgagcugcugguccuccuggagaacggccgcacccuggacuuccacgaccucaacgugaagaaccuguacgagaaggucaagagccagcugaagaacaacgcgaaggagaucgggaacggcugcuucgaguucuaccacaagugcgacaacgagugcauggaguccgugcggaacgggaccuacgacuaccccaaguacagcgaggaguccaagcucaaccgcgagaagaucgacggcgugaagcuggagagcaugggcgucuaccagauccuggccaucuacagcaccguggccuccagccucgugcugcuggucucccucggggccaucagcuucuggaugugcuccaacggcagccugcagugccggaucugcaucuga

SEQ ID NO: 63366 - RNA, 1704 nt, Artificial Sequence
  derived and/or modified sequence opt1 from hemagglutinin__InfluenzaA__ACG50699
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaugguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccucccugggcgucagcuccgcgugcccguaccagggcagcuccagcuucuuccgcaacgugguguggcucaucaagaagaacaacgccuaccccaccaucaagcgguccuacaacaacacgaaccaggaggaccugcugguccucugggggauccaccaccccaacgacgaggccgagcagacccgccuguaccagaacccgaccaccuacaucagcgugggcacguccacccugaaccagcggcucauccccaagaucgccacccgcagcaaggugaacgggcaguccggccggauggacuucuucuggaccauccugaagcccaacgacgcgaucaacuucgagagcaacgggaacuucaucgcccccgaguacgccuacaagaucgucaagaagggcgacagcgccaucaugaaguccgagguggaguacggcaacugcaacacgaagugccagaccccgaugggggccaucaacagcuccaugcccuuccacaacauccacccccugaccaucggcgagugccccaaguacgucaagagcaacaagcucgugcuggcgaccgggcugcgcaacuccccgcagcgggagcgccggcgcaagcggggccucuucggcgccaucgccggguucaucgagggcggguggcagggcaugguggacgggugguacggcuaccaccacagcaacgagcagggcuccggguacgccgccgacaaggagagcacgcagaaggcgaucgacggcgugaccaacaaggucaacuccaucaucgacaagaugaacacccaguucgaggccguggggcgcgaguucaacaaccuggagcggcgcaucgagaaccugaacaagaagauggaggacggcuuccucgacguguggaccuacaacgccgagcugcugguccucauggagaacgagcggacgcuggacuuccacgacagcaacgugaagaaccuguacgacaagguccgccuccagcugcgggacaacgccaaggagcuggggaacggcugcuucgaguucuaccacaagugcgacaacgagugcauggaguccgugcgcaacggcaccuacgacuacccccaguacagcgaggaggcccggcucaagcgcgaggagaucuccggggugaagcuggagagcaucggcaccuaccagauccuguccaucuacagcaccgucgcguccagccucgcccuggccaucaugguggccgggcugucccucuggaugugcagcaacggcagccugcagugccgcaucugcaucuga

SEQ ID NO: 63367 - RNA, 1701 nt, Artificial Sequence; identical to SEQ ID NO: 62936
  derived and/or modified sequence opt1 from hemagglutinin__InfluenzaA__ACG70142

SEQ ID NO: 63368 - RNA, 1701 nt, Artificial Sequence; identical to SEQ ID NO: 62936
  derived and/or modified sequence opt1 from hemagglutinin__InfluenzaA__ACG70153

SEQ ID NO: 63369 - RNA, 1701 nt, Artificial Sequence
  derived and/or modified sequence opt1 from hemagglutinin__InfluenzaA__ACG80410
augaagaccaucaucgcccugagcuacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacgcuggaguucaacaacgagagcuucaacuggaccggggugacccagaacggcaccuccagcgccugcauccggcgcuccaacaacagcuucuucucccggcugaacuggcucacgcaccuccgcuucaaguaccccgcccugaacgugaccaugcccaacaacgagcaguucgacaagcuguacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcaacgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 63370 - RNA, 1701 nt, Artificial Sequence
  derived and/or modified sequence opt1 from hemagglutinin__InfluenzaA__ACG80420
augcagaccaucaucgcccugagcuacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacgcuggaguucaacaacgagagcuucaacuggaccggggugacccagaacggcaccuccagcgccugcauccggcgcuccaacaacagcuucuucucccggcugaacuggcucacgcaccuccgcuucaaguaccccgcccugaacgugaccaugcccaacaacgagcaguucgacaagcuguacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcaacgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgggagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 63371 - RNA, 1701 nt, Artificial Sequence; identical to SEQ ID NO: 63369
  derived and/or modified sequence opt1 from hemagglutinin__InfluenzaA__ACG80426

SEQ ID NO: 63372 - RNA, 1701 nt, Artificial Sequence; identical to SEQ ID NO: 63369
  derived and/or modified sequence opt1 from hemagglutinin__InfluenzaA__ACG80430

SEQ ID NO: 63373 - RNA, 1701 nt, Artificial Sequence
  derived and/or modified sequence opt1 from hemagglutinin__InfluenzaA__ACG80436
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaagugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcaccuccgguucaaguaccccgcccugaacgugaccaugcccaacaacgagaacuucgacaagcuguacaucuggggcguccaccaccccgggaccgacaacgaccagaucuuccucuacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcugaucaacuccaccgggaaccucaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcuggcgaccggcaugcggaacgugcccgagaagcagacgcgcgggaucuucggcgccaucgccggguucaucgagaacggcugggagggcaugguggacgggugguacggcuuccggcaccagaacagcgaggggaucggccaggccgccgaccucaaguccacccaggcggcccuggaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacaacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 63374 - RNA, 1701 nt, Artificial Sequence
  derived and/or modified sequence opt1 from hemagglutinin__InfluenzaA__ACG80445
augaagaccaucaucgcccugagcuacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacgcuggaguucaacaacgagagcuucaacuggaccggggugacccagaacggcaccuccagcgccugcauccggcgcuccaacaacagcuucuucucccggcugaacuggcucacgcaccuccgcuucaaguaccccgcccugaacgugaccaugcccaacaacgagcaguucgacaagcuguacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcaacgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaaccagcugcgggagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 63375 - RNA, 1701 nt, Artificial Sequence; identical to SEQ ID NO: 63369
  derived and/or modified sequence opt1 from hemagglutinin__InfluenzaA__ACG80454

SEQ ID NO: 63376 - RNA, 1701 nt, Artificial Sequence; identical to SEQ ID NO: 63369
  derived and/or modified sequence opt1 from hemagglutinin__InfluenzaA__ACG80463

SEQ ID NO: 63377 - RNA, 1701 nt, Artificial Sequence
  derived and/or modified sequence opt1 from hemagglutinin__InfluenzaA__ACG80472
augaagaccaucaucgcccugagcuacauccucugccugguguucgcccagaagcugcccggcaacgacaacuccaccgcgacgcucugccuggggcaccacgccgucccgaacggcaccaucgugcgcaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcggagcaaggccuacuccaacugcuaccccuacgacgugccggacuacgcgagccugcgcucccucgucgccagcuccggcacgcuggaguucaacaacgagagcuucaacuggaccggggugacccagaacggcaccuccagcgccugcauccggcgcuccaacaacagcuucuucucccggcugaacuggcucacgcaccuccgcuucaaguaccccgcccugaacgugaccaugcccaacaacgagcaguucgacaagcuguacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggcccuggaccagaucaacgggaagcucaaccggcugaucggcaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacacgaucgaccugaccgacagcgagaugaacaagcuguucgagaagaccaagaagcagcuccgcgagaacgccgaggacauggggaacggcugcuucaagaucuaccacaagugcgacaacgcgugcaucggguccauccggaacggcaccuacgaccacaacgucuaccgcgacgaggcccugaacaaccgguuccagaucaaggggguggagcugaaguccggcuacaaggacuggauccucuggaucuccuucgccaucagcugcuuccugcugugcguggcccuccugggcuucaucaugugggccugccagaaggggaacauccgcugcaacaucugcaucuga

SEQ ID NO: 63378 - RNA, 1701 nt, Artificial Sequence
  derived and/or modified sequence opt1 from hemagglutinin__InfluenzaA__ACH69558
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcaacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccuccgguucaaguaccccgcccugaacgugaccaugcccaacaacgagaaguucgacaagcuguacaucuggggcguccaccaccccgggaccgacaacgaccagaucuuccuguacgcgcaggccagcggccgcaucaccguguccacgaagcggagccagcagaccgugaucccgaacaucggcagccgcccccggguccgcaacauccccucccggaucagcaucuacuggaccaucgugaagcccggggacauccugcucaucaacuccaccggcaaccugaucgccccgcgcggguacuucaagauccggagcggcaaguccagcaucaugcgcuccgacgcccccaucggcaagugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacagcgagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 63379 - RNA, 1701 nt, Artificial Sequence
  derived and/or modified sequence opt1 from hemagglutinin__InfluenzaA__ACH69569
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcaacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacagccugaagcucgcgaccgggaugcgcaacgugcccgagaagcagacccggggcaucuucggggccaucgccggcuucaucgagaacggcugggaggggaugguggacggcugguacggguuccgccaccagaacuccgagggcaucgggcaggccgccgaccugaaguccacgcaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacaccaucgaccucacggacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 63380 - RNA, 1701 nt, Artificial Sequence
  derived and/or modified sequence opt1 from hemagglutinin__InfluenzaA__ACH69580
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacgacuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucaaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 63381 - RNA, 1701 nt, Artificial Sequence
  derived and/or modified sequence opt1 from hemagglutinin__InfluenzaA__ACH69591
augaagaccaucaucgcccugagcuacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagagcuccagcaccgggcgcaucugcgacagcccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccagccuccgcucccugguggccagcuccggcacgcuggaguucaacaacgagagcuucaacuggaccggggucgcccagaacggcaccuccagcgcgugcaagcggcgcuccaucaacagcuucuucucccggcucaacuggcugcaccagcugaaguaccgcuaccccgcccucaacgugaccaugcccaacaacgacaaguucgacaagcuguacaucuggggcgugcaccaccccagcacggacuccgaccagaucagcgucuacgcccaggccagcgggcgggugaccguguccaccaagcgcagccagcagaccgucaucccgaacaucgggucccggcccugggugcgcggcaucagcucccggaucagcaucuacuggacgaucgugaagcccggcgacauccugcucaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgucaaccggaucaccuacggggccugcccgcgcuacgugaagcagaacacgcugaagcucgccaccggcaugcggaacgugcccgagaagcagacccgcgggaucuucggcgccaucgccggguucaucgagaacggcugggagggcaugauggacgggugguacggcuuccggcaccagaacagcgaggggaccggccaggcggccgaccugaaguccacgcaggccgccaucaaccagaucaacgggaagcugaacaagcucaucgagaagaccaacgagaaguuccaccagaucgagaacgaguucagcgaggucgagggccgcauccaggaccuggagaaguacguggaggacaccaagaucgaccugugguccuacaacgccgagcuccugguggcgcuggagaaccagcacaccaucgaccucacggacagcgagaugaacaagcuguucgagcggacccgcaagcagcugcgcgagaacgccgaggacaugggcaacgggugcuucaagaucuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgugguccugcucggcuucaucaugugggcgugccagaagggcaacauccgcugcaacaucugcaucuga

SEQ ID NO: 63382 - RNA, 1701 nt, Artificial Sequence
  derived and/or modified sequence opt1 from hemagglutinin__InfluenzaA__ACH69602
augaagaccaucaucgcccugagcuacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagagcuccagcaccgggcgcaucugcgacagcccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccagccuccgcucccugguggccagcuccggcacgcuggaguucaacaacgagagcuucaacuggaccggggucgcccagaacggcaccuccagcgcgugcaagcggcgcuccaucaacagcuucuucucccggcucaacuggcugcaccagcugaaguaccgcuaccccgcccucaacgugaccaugcccaacaacgacaaguucgacaagcuguacaucuggggcgugcaccaccccagcacggacuccgaccagaucagcgucuacgcccaggccagcgggcgggugaccguguccaccaagcgcagccagcagaccgucaucccgaacaucgggucccggcccugggugcgcggcaucagcucccggaucagcaucuacuggacgaucgugaagcccggcgacauccugcucaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgucaaccggaucaccuacggggccugcccgcgcuacgugaagcagaacacgcugaagcucgccaccggcaugcggaacgugcccgagaagcagacccgcgggaucuucggcgccaucgccggguucaucgagaacggcugggagggcaugauggacgggugguacggcuuccggcaccagaacagcgaggggaccggccaggcggccgaccugaaguccacgcaggccgccaucaaccagaucaacgggaagcugaacaagcucaucgagaagaccaacgagaaguuccaccagaucgagaaggaguucagcgaggucgagggccgcauccaggaccuggagaaguacguggaggacaccaagaucgaccugugguccuacaacgccgagcuccugguggcgcuggagaaccagcacaccaucgaccucacggacagcgagaugaacaagcuguucgagcggacccgcaagcagcugcgcgagaacgccgaggacaugggcaacgggugcuucaagaucuaccacaagugcgacaacgccugcaucggcuccauccggaacgggaccuacgaccacgacgucuaccgcgacgaggcccucaacaaccgguuccagaucaagggcguggagcugaaguccggguacaaggacuggauccuguggaucagcuucgccaucuccugcuuccuccugugcgugguccugcucggcuucaucaugugggcgugccagaagggcaacauccgcugcaacaucugcaucuga

SEQ ID NO: 63383 - RNA, 1701 nt, Artificial Sequence
  derived and/or modified sequence opt1 from hemagglutinin__InfluenzaA__ACH69613
augaagaccaucaucgcccugagcuacauccucugccuggccuucgcgcagaagcugcccggcaacgacaacuccaccccgacgcucugccuggggcaccacgccgugcccaacggcacccuggucaagaccaucaccaacgaccagaucgaggugacgaacgccaccgagcucgugcagagcuccagcaccgggggcaucugcgacagcccccaccagaucaucgacggggagaacugcacccugaucgacgcccugcucggcgacccccacugcgacggcuuccagaacaaggagugggaccuguucgucgagcgcuccaaggccuacuccaacugcuacccguacgacgugcccgacuacgcgagccugcggucccucguggccagcuccgggacgcuggaguucaacaacgagagcuucaacuggaccggcgucgcccagaacgggaccuccagcgccugcaagcgccgguccaucaacagcuucuucucccgccugaacuggcuccaccagcugaaguaccgguaccccgcgcugaacgugaccaugcccaacaacgacaaguucgacaagcucuacaucuggggcgugcaccacccgagcacggacuccgaccagaucagcgucuacgcccaggccagcgggcgcgugaccguguccaccaagcggagccagcagaccgucauccccaacaucggcucccgccccugggugcggggcaucagcucccgcaucagcaucuacuggacgaucgugaagcccggggacauccugcugaucaacuccaccggcaacccgaucgcgccccggggguacuucaagauccgcagcggcaaguccagcaucaugcgguccgacgcccccaucggcaagugcaacagcgagugcaucacccccaacggguccaucccgaacgacaagcccuuccagaacgucaaccgcaucaccuacggcgccugcccccgguacgugaagcagaacacgcucaagcuggccaccgggaugcgcaacgugcccgagaagcagacccggggcaucuucggggccaucgccggcuucaucgagaacggcugggaggggaugauggacggcugguacgggcugcgccaccagaacagcgagggcaccgggcaggccgcggaccucaaguccacgcaggccgccaucaaccagaucaacggcaagcugaacaagcugaucgagaagaccaacgagaaguuccaccagaucgagaacgaguucagcgaggucgagggccggauccaggaccucgagaaguacguggaggacaccaagaucgaccugugguccuacaacgccgagcugcucguggcccuggagaaccagcacaccaucgaccugacggacagcgagaugaacaagcuguucgagcgcacccggaagcagcuccgcgagaacgcggaggacauggggaacggcugcuucaagaucuaccacaagugcgacaacgccugcaucggguccauccgcaacggcaccuacgaccacgacgucuaccgggacgaggcccugaacaaccgcuuccagaucaaggggguggagcucaagagcggcuacaaggacuggauccuguggaucagcuucgccaucuccugcuuccugcucugcgugguccugcugggcuucaucaugugggccugccagaaggggaacauccggugcaacaucugcaucuga

SEQ ID NO: 63384 - RNA, 1701 nt, Artificial Sequence; identical to SEQ ID NO: 61638
  derived and/or modified sequence opt1 from hemagglutinin__InfluenzaA__ACH82060

SEQ ID NO: 63385 - RNA, 1701 nt, Artificial Sequence; identical to SEQ ID NO: 63324
  derived and/or modified sequence opt1 from hemagglutinin__InfluenzaA__ACI06123

SEQ ID NO: 63386 - RNA, 1701 nt, Artificial Sequence; identical to SEQ ID NO: 63324
  derived and/or modified sequence opt1 from hemagglutinin__InfluenzaA__ACI06126

SEQ ID NO: 63387 - RNA, 1701 nt, Artificial Sequence; identical to SEQ ID NO: 63324
  derived and/or modified sequence opt1 from hemagglutinin__InfluenzaA__ACI06127

SEQ ID NO: 63388 - RNA, 1701 nt, Artificial Sequence; identical to SEQ ID NO: 63324
  derived and/or modified sequence opt1 from hemagglutinin__InfluenzaA__ACI06129

SEQ ID NO: 63389 - RNA, 1701 nt, Artificial Sequence; identical to SEQ ID NO: 63324
  derived and/or modified sequence opt1 from hemagglutinin__InfluenzaA__ACI06130

SEQ ID NO: 63390 - RNA, 1701 nt, Artificial Sequence; identical to SEQ ID NO: 63324
  derived and/or modified sequence opt1 from hemagglutinin__InfluenzaA__ACI06132

SEQ ID NO: 63391 - RNA, 1701 nt, Artificial Sequence; identical to SEQ ID NO: 63326
  derived and/or modified sequence opt1 from hemagglutinin__InfluenzaA__ACI06133

SEQ ID NO: 63392 - RNA, 1701 nt, Artificial Sequence; identical to SEQ ID NO: 63326
  derived and/or modified sequence opt1 from hemagglutinin__InfluenzaA__ACI06134

SEQ ID NO: 63393 - RNA, 1701 nt, Artificial Sequence; identical to SEQ ID NO: 63326
  derived and/or modified sequence opt1 from hemagglutinin__InfluenzaA__ACI06135

SEQ ID NO: 63394 - RNA, 1701 nt, Artificial Sequence; identical to SEQ ID NO: 63326
  derived and/or modified sequence opt1 from hemagglutinin__InfluenzaA__ACI06136

SEQ ID NO: 63395 - RNA, 1701 nt, Artificial Sequence; identical to SEQ ID NO: 63326
  derived and/or modified sequence opt1 from hemagglutinin__InfluenzaA__ACI06137

SEQ ID NO: 63396 - RNA, 1701 nt, Artificial Sequence; identical to SEQ ID NO: 63326
  derived and/or modified sequence opt1 from hemagglutinin__InfluenzaA__ACI06138

SEQ ID NO: 63397 - RNA, 1701 nt, Artificial Sequence; identical to SEQ ID NO: 63326
  derived and/or modified sequence opt1 from hemagglutinin__InfluenzaA__ACI06139

SEQ ID NO: 63398 - RNA, 1701 nt, Artificial Sequence; identical to SEQ ID NO: 63326
  derived and/or modified sequence opt1 from hemagglutinin__InfluenzaA__ACI06140

SEQ ID NO: 63399 - RNA, 1701 nt, Artificial Sequence; identical to SEQ ID NO: 63326
  derived and/or modified sequence opt1 from hemagglutinin__InfluenzaA__ACI06141

SEQ ID NO: 63400 - RNA, 1701 nt, Artificial Sequence; identical to SEQ ID NO: 63326
  derived and/or modified sequence opt1 from hemagglutinin__InfluenzaA__ACI06142

SEQ ID NO: 63401 - RNA, 1701 nt, Artificial Sequence; identical to SEQ ID NO: 63326
  derived and/or modified sequence opt1 from hemagglutinin__InfluenzaA__ACI06143

SEQ ID NO: 63402 - RNA, 1701 nt, Artificial Sequence
  derived and/or modified sequence opt1 from hemagglutinin__InfluenzaA__ACI06144
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucaccgacagcgagaugaaccggcuguucgagaagacgcgccggcagcugcgcgagaacgccgaggacauggggaacggcugcuucaagaucuaccacaagugcgacaacgccugcaucgaguccauccgcaacggcaccuacgaccacgacguguaccgggacgaggcccucaacaaccgcuuccagaucaagggggucgagcucaagagcggcuacaaggacuggauccuguggaucuccuucgcgaucagcugcuuccugcugugcguggugcugcucggguucaucaugugggccugccagcggggcaacauccgcugcaacaucugcaucuga

SEQ ID NO: 63403 - RNA, 1701 nt, Artificial Sequence; identical to SEQ ID NO: 63326
  derived and/or modified sequence opt1 from hemagglutinin__InfluenzaA__ACI06145

SEQ ID NO: 63404 - RNA, 1701 nt, Artificial Sequence
  derived and/or modified sequence opt1 from hemagglutinin__InfluenzaA__ACI06146
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagcucccccugggugcgcggccugagcucccggaucagcaucuacuggaccaucgucaagcccggggacgugcucgugaucaacuccaacggcaaccugaucgcgccgcgcggguacuucaagaugcggaccggcaagagcuccaucaugcgcagcgacgcccccaucgacacgugcaucuccgagugcaucacccccaacgggagcauccccaacgacaagccguuccagaacgucaacaagaucaccuacggcgccugccccaaguacgugaagcagaacacccugaagcucgccacgggcaugcggaacgugcccgagaagcagacccgcgggcuguucggcgccaucgcgggguucaucgagaacggcugggaggggaugaucgacggcugguacggcuuccggcaccagaacuacgaggggaccggccaggccgccgaccugaaguccacccaggccgccaucgaccagaucaacgggaagcucaaccgcgucaucgagaagacgaacgagaaguuccaccagaucgagaaggaguucagcgagguggagggccggauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcgccggcagcugcgcgagaacgccgaggacauggggaacggcugcuucaagaucuaccacaagugcgacaacgccugcaucgaguccauccggaacggcaccuacgaccacgacguguaccgcgacgaggcccucaacaaccgcuuccagaucaagggggucgagcucaagagcggcuacaaggacuggauccuguggaucuccuucgcgaucagcugcuuccugcugugcguggugcugcucggguucaucaugugggccugccagcggggcaacauccgcugcaacaucugcaucuga

SEQ ID NO: 63405 - RNA, 1701 nt, Artificial Sequence; identical to SEQ ID NO: 63326
  derived and/or modified sequence opt1 from hemagglutinin__InfluenzaA__ACI06147

SEQ ID NO: 63406 - RNA, 1701 nt, Artificial Sequence; identical to SEQ ID NO: 63326
  derived and/or modified sequence opt1 from hemagglutinin__InfluenzaA__ACI06148

SEQ ID NO: 63407 - RNA, 1701 nt, Artificial Sequence
  derived and/or modified sequence opt1 from hemagglutinin__InfluenzaA__ACI06149
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccgccagaccaucauccccaacaucggcagccggcccugggugcgcggccuguccagccggaucuccaucuacuggaccaucgucaagcccggggacgugcucgugaucaacagcaacggcaaccugaucgcgccgcgcggguacuucaagaugcggaccggcaaguccagcaucaugcgcuccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcggaacgugcccgagaagcagacccgcgggcuguucggcgccaucgcgggguucaucgagaacggcugggaggggaugaucgacggcugguacggcuuccggcaccagaacagcgaggggaccggccaggccgccgaccugaaguccacccaggccgccaucgaccagaucaacgggaagcucaaccgcgucaucgagaagacgaacgagaaguuccaccagaucgagaaggaguucagcgagguggagggccggauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcgccggcagcugcgcgagaacgccgaggacauggggaacggcugcuucaagaucuaccacaagugcgacaacgccugcaucgaguccauccgcaacggcaccuacgaccacgacguguaccgggacgaggcccucaacaaccgcuuccagaucaagggggucgagcucaagagcggcuacaaggacuggauccuguggaucuccuucgcgaucagcugcuuccugcugugcguggugcugcucggguucaucaugugggccugccagcggggcaacauccgcugcaacaucugcaucuga

SEQ ID NO: 63408 - RNA, 1701 nt, Artificial Sequence; identical to SEQ ID NO: 63337
  derived and/or modified sequence opt1 from hemagglutinin__InfluenzaA__ACI06151

SEQ ID NO: 63409 - RNA, 1701 nt, Artificial Sequence; identical to SEQ ID NO: 63337
  derived and/or modified sequence opt1 from hemagglutinin__InfluenzaA__ACI06152

SEQ ID NO: 63410 - RNA, 1701 nt, Artificial Sequence
  derived and/or modified sequence opt1 from hemagglutinin__InfluenzaA__ACI06153
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgagcucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgugaacaagaucaccuacggcgccugccccaaguacgucaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggugaucgagaagacgaacgagaaguuccaccagaucgagaaggaguucagcgaggucgagggccgcauccaggaccuggagaaguacguggaggacaccaagaucgaccugugguccuacaacgcggagcuccugguggcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacgucuaccgcgacgaggcccucaacaaccgguuccagaucaaggggguggagcucaagagcggcuacaaggacuggauccuguggaucuccuucgcgaucagcugcuuccugcugugcgucgugcugcucggguucaucaugugggccugccagcgcggcaacauccggugcaacaucugcaucuga

SEQ ID NO: 63411 - RNA, 1701 nt, Artificial Sequence
  derived and/or modified sequence opt1 from hemagglutinin__InfluenzaA__ACI06155
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucgagagccgccccugggugcggggccuguccagccgcaucuccaucuacuggaccaucgucaagcccggcgacgugcucgugaucaacagcaacgggaaccugaucgcgccgcggggcuacuucaagaugcgcaccgggaaguccagcaucguccgguccgacgcccccaucgacacgugcaucagcgagugcaucacccccaacggcuccauccccaacgacaagccguuccagaacgugaacaagaucaccuacggggccugccccaaguacgugaagcagaacacccugaagcucgccacgggcaugcgcaacguccccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggugaucgagaagacgaacgagaaguuccaccagaucgagaaggaguucagcgagguggaggggcgcauccaggaccuggagaaguacgucgaggacaccaagaucgaccugugguccuacaacgcggagcuccugguggcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacgucuaccgcgacgaggcccucaacaaccgguuccagaucaagggcguggagcucaagagcggguacaaggacuggauccuguggaucuccuucgcgaucagcugcuuccugcugugcgugguccugcucggcuucaucaugugggccugccagcgcgggaacauccggugcaacaucugcaucuga

SEQ ID NO: 63412 - RNA, 1701 nt, Artificial Sequence; identical to SEQ ID NO: 63337
  derived and/or modified sequence opt1 from hemagglutinin__InfluenzaA__ACI06156

SEQ ID NO: 63413 - RNA, 1701 nt, Artificial Sequence; identical to SEQ ID NO: 63337
  derived and/or modified sequence opt1 from hemagglutinin__InfluenzaA__ACI06157

SEQ ID NO: 63414 - RNA, 1701 nt, Artificial Sequence; identical to SEQ ID NO: 63337
  derived and/or modified sequence opt1 from hemagglutinin__InfluenzaA__ACI06158

SEQ ID NO: 63415 - RNA, 1701 nt, Artificial Sequence; identical to SEQ ID NO: 63337
  derived and/or modified sequence opt1 from hemagglutinin__InfluenzaA__ACI06159

SEQ ID NO: 63416 - RNA, 1701 nt, Artificial Sequence; identical to SEQ ID NO: 63326
  derived and/or modified sequence opt1 from hemagglutinin__InfluenzaA__ACI06160

SEQ ID NO: 63417 - RNA, 1701 nt, Artificial Sequence
  derived and/or modified sequence opt1 from hemagglutinin__InfluenzaA__ACI06161
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucgagagccgccccugggugcggggccuguccagccgcaucuccaucuacuggaccaucgucaagcccggcgacgugcucgugaucaacagcaacgggaaccugaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaagggcaccuacgaccacgacguguaccgcgacgaggcccucaacaaccgguuccagaucaagggcgucgagcucaagagcggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 63418 - RNA, 1701 nt, Artificial Sequence
  derived and/or modified sequence opt1 from hemagglutinin__InfluenzaA__ACI06162
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucgagagccgccccugggugcggggccuguccagccgcaucuccaucuacuggaccaucgucaaccccggcgacgugcucgugaucaacagcaacgggaaccugaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaagggcgucgagcucaagagcggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 63419 - RNA, 1701 nt, Artificial Sequence
  derived and/or modified sequence opt1 from hemagglutinin__InfluenzaA__ACI06163
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaagggcaccuacgaccacgacguguaccgcgacgaggcccucaacaaccgguuccagaucaagggggucgagcucaagagcggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 63420 - RNA, 1701 nt, Artificial Sequence
  derived and/or modified sequence opt1 from hemagglutinin__InfluenzaA__ACI06164
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucaacaucuacuggaccaucgucaagcccggggacgugcucgugaucaacuccaacggcaaccugaucgcgccgcggggguacuucaagaugcgcaacggcaagagcuccaucaugcggagcgacgcccccaucgacacgugcaucuccgagugcaucacccccaacgggagcauccccaacgacaagccguuccagaacgucaacaagaucaccuacggcgccugccccaaguacgugaagcagaacacccugaagcucgccaccggcaugcgcaacgugcccgagaagcagacgcgggggcuguucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggucaucgagaagaccaacgagaaguuccaccagaucgagaaggaguucuccgagguggagggccgcauccaggaccuggagaaguacguggaggacacgaagaucgaccuguggagcuacaacgcggagcuccuggucgcccuggagaaccagcacaccaucgaccucaccgacuccgagaugaacaagcuguucgagaagacccggcgccagcugcgggagaacgccgaggacauggggaacggcugcuucaagaucuaccacaagugcgacaacgccugcaucgagagcauccgcaacggcacguacgaccacgacguguaccgcgacgaggcccucaacaaccgguuccagaucaagggggucgagcugaaguccggcuacaaggacuggauccuguggaucagcuucgcgaucuccugcuuccuccugugcguggugcugcucggguucaucaugugggccugccagcgcggcaacauccggugcaacaucugcaucuga

SEQ ID NO: 63421 - RNA, 1701 nt, Artificial Sequence
  derived and/or modified sequence opt1 from hemagglutinin__InfluenzaA__ACI06165
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaacggcaaguccagcaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccaccggcaugcgcaacgugcccgagaagcagacgcgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagaccaacgagaaguuccaccagaucgagaaggaguucagcgagguggagggccgcauccaggaccuggagaaguacguggaggacacgaagaucgaccugugguccuacaacgcggagcuccuggucgcccuggagaaccagcacaccaucgaccucaccgacagcgagaugaacaagcuguucgagaagacccggcgccagcugcgggagaacgccgaggacauggggaacggcugcuucaagaucuaccacaagugcgacaacgccugcaucgaguccauccgcaacggcacguacgaccacgacguguaccgcgacgaggcccucaacaaccgguuccagaucaagggggucgagcucaagagcggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 63422 - RNA, 1701 nt, Artificial Sequence
  derived and/or modified sequence opt1 from hemagglutinin__InfluenzaA__ACI06166
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccuggauccggggccuguccagccgcaucaacaucuacuggaccaucgugaagcccggggacguccucgugaucaacuccaacggcaaccugaucgcgccgcggggguacuucaagaugcgcaacggcaagagcuccaucaugcggagcgacgcccccaucgacacgugcaucuccgagugcaucacccccaacgggagcauccccaacgacaagccguuccagaacgugaacaagaucaccuacggcgccugccccaaguacgucaagcagaacacccugaagcucgccaccggcaugcgcaacgugcccgagaagcagacgcgggggcuguucggcgccaucgcgggguucaucgagaacggcugggaggggaugaucgacggcugguacggcuuccgccaccagaacuccgaggggaccggccaggccgccgaccucaagagcacccaggccgccaucgaccagaucaacgggaagcugaaccgggugaucgagaagaccaacgagaaguuccaccagaucgagaaggaguucuccgaggucgagggccgcauccaggaccuggagaaguacguggaggacacgaagaucgaccuguggagcuacaacgcggagcuccugguggcccuggagaaccagcacaccaucgaccucaccgacuccgagaugaacaagcuguucgagaagacccggcgccagcugcgggagaacgccgaggacauggggaacggcugcuucaagaucuaccacaagugcgacaacgccugcaucgagagcauccgcaacggcacguacgaccacgacgucuaccgcgacgaggcccucaacaaccgguuccagaucaaggggguggagcugaaguccggcuacaaggacuggauccuguggaucagcuucgcgaucuccugcuuccuccugugcgucgugcugcucggguucaucaugugggccugccagcgcggcaacauccggugcaacaucugcaucuga

SEQ ID NO: 63423 - RNA, 1701 nt, Artificial Sequence; identical to SEQ ID NO: 63407
  derived and/or modified sequence opt1 from hemagglutinin__InfluenzaA__ACI06167

SEQ ID NO: 63424 - RNA, 1701 nt, Artificial Sequence
  derived and/or modified sequence opt1 from hemagglutinin__InfluenzaA__ACI06168
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggaagcagcugcgcgagaacgccgaggacauggggaacggcugcuucaagaucuaccacaagugcgacaacgccugcaucgaguccauccggaacggcaccuacgaccacgacguguaccgcgacgaggcccucaacaaccgcuuccagaucaagggggucgagcucaagagcggcuacaaggacuggauccuguggaucuccuucgcgaucagcugcuuccugcugugcguggugcugcucggguucaucaugugggccugccagcggggcaacauccgcugcaacaucugcaucuga

SEQ ID NO: 63425 - RNA, 1701 nt, Artificial Sequence; identical to SEQ ID NO: 63326
  derived and/or modified sequence opt1 from hemagglutinin__InfluenzaA__ACI06169

SEQ ID NO: 63426 - RNA, 1701 nt, Artificial Sequence; identical to SEQ ID NO: 63343
  derived and/or modified sequence opt1 from hemagglutinin__InfluenzaA__ACI06171

SEQ ID NO: 63427 - RNA, 1701 nt, Artificial Sequence; identical to SEQ ID NO: 63343
  derived and/or modified sequence opt1 from hemagglutinin__InfluenzaA__ACI06172

SEQ ID NO: 63428 - RNA, 1701 nt, Artificial Sequence
  derived and/or modified sequence opt1 from hemagglutinin__InfluenzaA__ACI06173
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgagaucaacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgugaacaagaucaccuacggcgccugccccaaguacgucaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggugaucgagaagacgaacgagaaguuccaccagaucgagaaggaguucagcgaggucgagggccgcauccaggaccuggagaaguacguggaggacaccaagaucgaccugugguccuacaacgcggagcuccugguggcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacgucuaccgcgacgaggcccucaacaaccgguuccagaucaaggggguggagcucaagagcggcuacaaggacuggauccuguggaucuccuucgcgaucagcugcuuccugcugugcgucgugcugcucggguucaucaugugggccugccagcgcggcaacauccggugcaacaucugcaucuga

SEQ ID NO: 63429 - RNA, 1701 nt, Artificial Sequence; identical to SEQ ID NO: 63343
  derived and/or modified sequence opt1 from hemagglutinin__InfluenzaA__ACI06174

SEQ ID NO: 63430 - RNA, 1701 nt, Artificial Sequence; identical to SEQ ID NO: 63344
  derived and/or modified sequence opt1 from hemagglutinin__InfluenzaA__ACI06175

SEQ ID NO: 63431 - RNA, 1701 nt, Artificial Sequence; identical to SEQ ID NO: 63344
  derived and/or modified sequence opt1 from hemagglutinin__InfluenzaA__ACI06176

SEQ ID NO: 63432 - RNA, 1701 nt, Artificial Sequence; identical to SEQ ID NO: 63344
  derived and/or modified sequence opt1 from hemagglutinin__InfluenzaA__ACI06177

SEQ ID NO: 63433 - RNA, 1689 nt, Artificial Sequence
  derived and/or modified sequence opt1 from hemagglutinin__InfluenzaA__ACI25724
auggccaucaucuaccugauccuccuguucgccaccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagcgcgagaacccccgguacucccucugcuacccgggcagccugaacgacuacgaggagcugaagcaccuccuguccagcgugaagcacuucgagaaggugcgcauccugcccaaggaccgguggacgcagcacaccaccaccgggggcuccaaggccugcgccgucagcgggaagcccuccuucuuccgcaacaugguguggcucacgaagaagggccccaacuacccgguggcgaaggggagcuacaacaacaccuccggcgagcagaugcugaucaucuggggcguccaccaccccaaggacgaggccgagcagcgggcccuguaccaggagguggggaccuacgugagcgccuccaccagcacgcucaacaagcgcuccauccccgagaucgcggcccggcccgaggucaacggccuggggagccgcauggaguucuccuggacccugcucgacgugugggacaccaucaacuucgagagcaccggcaaccugguggccccggaguacggcuucaagaucuccaagcgggggagcagcggcaucaugaagacggaggggacccugggcaacugcgagaccaagugccagacgccccucggggccaucaacaccacccugcccuuccacaacguccacccccugaccaucggcgagugcccgaaguacgugaaguccgagaagcucgugcuggccaccggccugcgcaacgucccccagaucgagagccggggccucuucggggcgaucgccggguucaucgagggcggguggcagggcaugguggacggcugguacggguaccaccacuccaacgaccagggcagcggguacgccgccgacaaggaguccacgcagaaggccuucgacggcaucaccaacaaggugaacagcgucaucgagaagaugaacacccaguucgaggcgguggggaaggaguucaacaaccuggagaagcgccuggagaaccucaacaagaagauggaggacggcuuccuggacguguggaccuacaacgccgagcugcucguccugauggagaacgagcggacgcuggacuuccacgacuccaacgugaagaaccucuacgagaagguccgcaugcagcugcgggacaacgugaaggagcugggcaacgggugcuucgaguucuaccacaagugcgacgacgagugcaugaacagcgugaagaacggcaccuacgacuaccccaaguacgaggaggaguccaagcucaagcgcaacgagaucaagggggucaagcugagcuccaugggcguguaccagauccuggccaucuacgccaccguggccggcagccucucccuggcgaucauggucgccgggaucagcuucuggaugugcuccaacggcagccugcagugccggaucugcaucuga

SEQ ID NO: 63434 - RNA, 1701 nt, Artificial Sequence
  derived and/or modified sequence opt1 from hemagglutinin__InfluenzaA__ACI25746
augaagaccaucaucgcccugagcuacaucuucugccucgcccugggccaguaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucggcagccgccccugggugcggggccuguccagccgcaucuccaucuacuggaccaucgucaagcccggggacgugcucgugaucgacagcaacggcaaccugaucgcgccgcggggguacuucaagaugcgcaccggcaaguccagcaucaugcgguccgacgcccccaucgacacgugcaucagcgagugcaucacccccaacggguccauccccaacgacaagccguuccagaacgucaacaagaucaccuacggcgccugccccaaguacgugaagcagaacacccugaagcucgccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccugaaguccacccaggccgccaucgaccagaucaacgggaagcucaaccgggucaucgagaagacgaacgagaaguuccaccagaucgagaaggaguucagcgagguggagggccgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacauggggaacggcugcuucaagaucuaccacaagugcgacaacgccugcaucgaguccauccgcaacggcaccuacgaccacgacguguaccgcgacgaggcccucaacaaccgguuccagaucaagggggucgagcucaagagcggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 63435 - RNA, 1701 nt, Artificial Sequence
  derived and/or modified sequence opt1 from hemagglutinin__InfluenzaA__ACI25757
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccuggugcucaacgucacgaugcccaacaacgacaacuucgacaagcuguacaucuggggcgugcaccaccccagcaccaaccaggagcagaccucccuguacgugcaggccagcgggcgggucaccguguccacgcgccggagccagcagaccaucaucccgaacaucggcagccgccccugggugcggggccucuccagccgcaucuccaucuacuggaccaucgucaagcccggggacgugcuggugaucaacagcaacggcaaccugaucgcgccccggggguacuucaagaugcgcaccggcaaguccagcaucaugcgguccgacgccccgaucgacacgugcaucagcgagugcaucacccccaacggguccauccccaacgacaagcccuuccagaacgucaacaagaucaccuacggcgccugcccgaaguacgugaagcagaacacccucaagcuggccacgggcaugcgcaacgugcccgagaagcagacccgggggcuguucggcgccaucgcgggguucaucgagaacggcugggaggggaugaucgacggcugguacggcuuccgccaccagaacagcgaggggaccggccaggccgccgaccucaaguccacccaggccgccaucgaccagaucaacgggaagcugaaccgggucaucgagaagacgaacgagaaguuccaccagaucgagaaggaguucagcgagguggagggccgcauccaggaccuggagaaguacguggaggacaccaagaucgaccucugguccuacaacgcggagcugcuggucgcccucgagaaccagcacaccaucgaccugaccgacagcgagaugaacaagcuguucgagaagacgcggcgccagcuccgggagaacgccgaggacauggggaacggcugcuucaagaucuaccacaagugcgacaacgccugcaucgaguccauccgcaacggcaccuacaaccacgacguguaccgcgacgaggcccugaacaaccgguuccagaucaagggggucgagcucaagagcggcuacaaggacuggauccuguggaucuccuucgcgaucagcugcuuccugcugugcguggugcuccugggguucaucaugugggccugccagcgcggcaacauccggugcaacaucugcaucuga

SEQ ID NO: 63436 - RNA, 1701 nt, Artificial Sequence; identical to SEQ ID NO: 63324
  derived and/or modified sequence opt1 from hemagglutinin__InfluenzaA__ACI25768

SEQ ID NO: 63437 - RNA, 1701 nt, Artificial Sequence
  derived and/or modified sequence opt1 from hemagglutinin__InfluenzaA__ACI25779
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucuggagccgccccugggugcggggccuguccagccgcaucuccaucuacuggaccaucgucaagcccggcgacgugcucgugaucaacagcaacgggaaccugaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaagggcgucgagcucaagagcggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 63438 - RNA, 1701 nt, Artificial Sequence
  derived and/or modified sequence opt1 from hemagglutinin__InfluenzaA__ACI25790
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucuggagccgccccugggugcggggccuguccagccgcaucuccaucuacuggaccaucgucaagcccggcgacgugcucgugaucaacagcaacgggaaccugaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcagcggcaccuacgaccacgacguguaccgcgacgaggcccucaacaaccgguuccagaucaagggcgucgagcugaaguccggguacaaggacuggauccuguggaucagcuucgcgaucuccugcuuccuccugugcguggugcugcucggcuucaucaugugggccugccagcgcgggaacauccggugcaacaucugcaucuga

SEQ ID NO: 63439 - RNA, 1701 nt, Artificial Sequence
  derived and/or modified sequence opt1 from hemagglutinin__InfluenzaA__ACI25801
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucaacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgaggacuucaccuggacgggggugacccagaacggcggguccaacgccugcaagcggggccccgggagcggcuucuucucccgccucaacuggcugaccaagagcggcuccaccuaccccgugcuggacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucgggagccgccccugggugcggggccuguccagccgcaucuccaucuacuggaccaucgucaagcccggcgacgugcucgugaucaacagcaacgggaaccugaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaagggcgucgagcucaagagcggguacaaggacuggauccuguggaucuccuucgcgaucagcugcuuccugcugugcguggugcugcucggcuucaucaugugggccugccagcgcgggaacauccggugcaacaucugcaucuga

SEQ ID NO: 63440 - RNA, 1689 nt, Artificial Sequence; identical to SEQ ID NO: 63358
  derived and/or modified sequence opt1 from hemagglutinin__InfluenzaA__ACI26274

SEQ ID NO: 63441 - RNA, 1698 nt, Artificial Sequence
  derived and/or modified sequence opt1 from hemagglutinin__InfluenzaA__ACI26307
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaacaacagcuucuucucccgccugaacuggcucacccaccugaaguucaaguaccccgcccugaacgugaccaugcccaacaacgagaaguucgacaagcucuacaucuggggcguccaccaccccgugaccgacaacgaccagaucuuccuguacgcccagagcgggcggaucacgguguccaccaagcgcagccagcagaccgucaucccgaacaucgggagccggccccgcgugcggaacucccccagccgcaucuccaucuacuggaccaucgugaagcccggcgacauccugcucaucaacagcacgggcaaccugaucgcgccgcggggguacuucaagauccgcuccggcaagagcuccaucaugcggagcgacgcccccaucgggaagugcaacuccgagugcaucacccccaacggcagcauccccaacgacaagccguuccagaacgucaaccgcaucaccuacggcgccugcccccgguacgugaagcagaacacccugaagcucgccacggggaugcgcaacgugcccgagaagcagacccggggcaucuucggggccaucgcgggcuucaucgagaacgggugggagggcauggucgacggcugguacggguuccgccaccagaacuccgagggcaucgggcaggccgccgaccugaaguccacccaggccgccaucgaccagaucaacggcaagcugaaccggcucaucgggaagaccaacgagaaguuccaccagaucgagaaggaguucuccgagguggagggccgcauccaggaccuggagaaguacguggaggacacgaagaucgaccuguggagcuacaacgcggagcuccuggucgcccuggagaaccagcacaccaucgaccucaccgacuccgagaugaacaagcuguucgagaagaccaagaagcagcugcgggagaacgccgaggacaugggcaacgggugcuucaagaucuaccacaagugcgacaacgccugcaucggcagcauccgcaacgggacguacgaccacgacguguaccgcgacgaggcccucaacaaccgguuccagaucaagggcguggagcugaaguccggguacaaggacuggauccuguggaucagcuucgcgaucuccugcuuccuccugugcgucgcccugcucggcuucaucaugugggccugccagaagggcaacauccgcugcaacaucugcaucuga

SEQ ID NO: 63442 - RNA, 1701 nt, Artificial Sequence
  derived and/or modified sequence opt1 from hemagglutinin__InfluenzaA__ACI26362
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 63443 - RNA, 1701 nt, Artificial Sequence
  derived and/or modified sequence opt1 from hemagglutinin__InfluenzaA__ACI26373
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacugggccggggugacccagaacggcaccuccagcgccugcauccgcaaguccaacaacagcuucuucucccggcugaacuggcucacccaccugaaguucaaguaccccgcgcugaacgugacgaugcccaacaacgagcaguucgacaagcucuacaucuggggcguccaccaccccgggaccgacaacgaccagaucuuccuguacgcccaggccagcgggcgcaucaccguguccaccaagcggagccagcagacggugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacccccaacggcuccauccccaacgacaagccguuccagaacgugaaccggaucacguacggggcgugcccccgcuacgucaagcagaacacccugaagcucgccaccggcaugcggaacgugcccgagaagcagacccgcgggaucuucggcgccaucgccggguucaucgagaacggcugggagggcaugguggacgggugguacggcuuccggcaccagaacagcgaggggcgcggccaggccgcggaccugaaguccacgcaggccgccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgggagaacgcggaggacauggggaacggcugcuucaagaucuaccacaagugcgacaacgccugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggcgugccagaaggggaacauccgcugcaacaucugcaucuga

SEQ ID NO: 63444 - RNA, 1701 nt, Artificial Sequence; identical to SEQ ID NO: 63309
  derived and/or modified sequence opt1 from hemagglutinin__InfluenzaA__ACI26395

SEQ ID NO: 63445 - RNA, 1701 nt, Artificial Sequence
  derived and/or modified sequence opt1 from hemagglutinin__InfluenzaA__ACI26406
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaagcaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 63446 - RNA, 1701 nt, Artificial Sequence; identical to SEQ ID NO: 62936
  derived and/or modified sequence opt1 from hemagglutinin__InfluenzaA__ACI26417

SEQ ID NO: 63447 - RNA, 1701 nt, Artificial Sequence
  derived and/or modified sequence opt1 from hemagglutinin__InfluenzaA__ACI26428
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagaucagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgcgucccugcggagccucgucgccuccagcgggacgcuggaguucaacaacgaguccuucaacuggaccggcgugacccagaacgggaccagcuccagcugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgugaccgacaacgaccagauccggcuguacgcccaggcgagcgggcgcaucaccguguccacgaagcggagccagcagaccgucaucccgaacaucggcuaccgcccccgggugcgcgacauccccagccggaucuccaucuacuggaccaucgugaagcccggcgacauccugcucaucaacagcaccgggaaccugaucgccccgcgcggcuacuucaagauccgguccggcaagagcuccaucaugcgcagcgacgcccccaucgggaagugcaacuccgagugcaucacgcccaacggcagcauccccaacgacaagccguuccagaacgucaaccggaucaccuacggggccugcccccgcuacgugaagcagaacacccugaagcucgccaccggcaugcggaacgugcccgagaagcagacgcgcgggaucuucggcgcgaucgccggguucaucgagaacggcugggagggcauggucgacgggugguacggcuuccggcaccagaacuccgaggggaucggccaggccgccgaccucaagagcacccaggccgcgaucaaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacacgaucgaccucaccgacuccgagaugaacaagcuguucgagcgcaccaagaagcagcugcgcgagaacgccgaggacauggggaacggcugcuucaagaucuaccacaagugcgacaacgccugcaucgggagcauccggaacggcaccuacgaccacgacguguaccgcgacgaggcgcucaacaaccgguuccagaucaaggggguggagcugaaguccggcuacaaggacuggauccuguggaucagcuucgccaucuccugcuuccuccugugcgucgugcugcucggcuucaucaugugggccugccagaaggggaacauccgcugcaacaucugcaucuga

SEQ ID NO: 63448 - RNA, 1698 nt, Artificial Sequence
  derived and/or modified sequence opt1 from hemagglutinin__InfluenzaA__ACI26439
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcaaccagcgcgcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacguguggaccuacaacgccgagcugcuggugcuccuggagaacgagcggacgcuggacuuccacgacagcaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugucccgcgagaagaucgacggcgucaagcucgagagcaugggcguguaccagauccuggccaucuacagcaccguggccuccagccugguccuccuggugucccugggggccaucagcuucuggaugugcuccaacggcagccuccagugccggaucugcaucuga

SEQ ID NO: 63449 - RNA, 1698 nt, Artificial Sequence; identical to SEQ ID NO: 63448
  derived and/or modified sequence opt1 from hemagglutinin__InfluenzaA__ACI26450

SEQ ID NO: 63450 - RNA, 1701 nt, Artificial Sequence
  derived and/or modified sequence opt1 from hemagglutinin__InfluenzaA__ACI26461
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcuccaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucuucccguacgcccaggcgagcgggcggaucacgguguccaccaagcgcagccagcagaccgugauccccaacaucggcagccggccccgcguccggaacauccccucccgcaucagcaucuacuggaccaucgugaagccgggcgacauccugcugaucaacuccacggggaaccucaucgcgccccggggcuacuucaagauccgcagcgggaaguccagcaucaugcgguccgacgcccccaucggcaagugcaacagcgagugcaucacccccaacggcuccaucccgaacgacaagcccuuccagaacgugaaccgcaucaccuacggggccugcccccgguacgucaagcagaacacccugaagcuggccacgggcaugcgcaacgugcccgagaagcagacccgggggaucuucggcgccaucgccggguucaucgagaacggcugggagggcaugguggacgggugguacggcuuccgccaccagaacagcgaggggaucggccaggccgccgaccucaaguccacccaggccgcgaucgaccagaucaacgggaagcugaaccggcugaucggcaagaccaacgagaaguuccaccagaucgagaaggaguucagcgaggucgagggccgcauccaggaccucgagaaguacguggaggacacgaagaucgaccugugguccuacaacgccgagcugcucguggcccuggagaaccagcacaccaucgaccugaccgacagcgagaugaacaagcuguucgagaagaccaagaagcagcuccgggagaacgccgaggacauggggaacggcugcuucaagaucuaccacaagugcgacaacgccugcaucggguccauccgcaacggcacguacgaccacaacgucuaccgcgacgaggcgcugaacaaccgguuccagaucaaggggguggagcucaagagcggcuacaaggacuggauccuguggaucuccuucgccaucagcugcuuccugcucugcguggcccugcugggcuucaucaugugggccugccagaaggggaacauccgcugcaacaucugcaucuga

SEQ ID NO: 63451 - RNA, 1698 nt, Artificial Sequence
  derived and/or modified sequence opt1 from hemagglutinin__InfluenzaA__ACI26472
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaacaacagcuucuucucccgccugaacuggcucacccaccugaaguucaaguaccccgcccugaacgugaccaugcccaacaacgagaaguucgacaagcucuacaucuggggcguccaccaccccgugaccgacaacgaccagaucuuccuguacgcccagagcgggcggaucacgguguccaccaagcgcagccagcagaccgucaucccgaacaucggguaccggccccgcgugcggaacauccccagccgcaucuccaucuacuggaccaucgugaagcccggcgacauccugcucaucaacagcacgggcaaccugaucgcgccgcggggguacuucaagauccgcuccggcaagagcuccaucaugcggagcgacgcccccaucgggaagugcaacuccgagugcaucacccccaacggcagcauccccaacgacaagccguuccagaacgucaaccgcaucaccuacggcgccugcccccgguacgugaagcagaacacccugaagcucgccacggggaugcgcaacgugcccgagaagcagacccggggcaucuucggggccaucgcgggcuucaucgagaacgggugggagggcauggucgacggcugguacggguuccgccaccagaacuccgagggcaucgggcaggccgccgaccugaaguccacccaggccgccaucgaccagaucaacggcaagcugaaccggcucaucgggaagaccaacgagaaguuccaccagaucgagaaggaguucuccgagguggagggccgcauccaggaccuggagaaguacguggaggacacgaagaucgaccuguggagcuacaacgcggagcuccuggucgcccuggagaaccagcacaccaucgaccucaccgacuccgagaugaacaagcuguucgagaagaccaagaagcagcugcgggagaacgccgaggacaugggcaacgggugcuucaagaucuaccacaagugcgacaacgccugcaucggcagcauccgcaacgggacguacgaccacgacguguaccgcgacgaggcccucaacaaccgguuccagaucaagggcguggagcugaaguccggguacaaggacuggauccuguggaucagcuucgcgaucuccugcuuccuccugugcgucgcccugcucggcuucaucaugugggccugccagaagggcaacauccgcugcaacaucugcaucuga

SEQ ID NO: 63452 - RNA, 1701 nt, Artificial Sequence; identical to SEQ ID NO: 63443
  derived and/or modified sequence opt1 from hemagglutinin__InfluenzaA__ACI26483

SEQ ID NO: 63453 - RNA, 1701 nt, Artificial Sequence
  derived and/or modified sequence opt1 from hemagglutinin__InfluenzaA__ACI26505
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacugggccggggugacccagaacggcaccuccagcgccugcauccgcaaguccaacaacagcuucuucucccggcugaacuggcucacccaccugaaguucaaguaccccgcgcugaacgugacgaugcccaacaacgagcaguucgacaagcucuacaucuggggcguccaccaccccgggaccgacaacgaccagaucuuccuguacgcccaggccagcgggcgcaucaccguguccaccaagcggagccagcagacggugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacccccaacggcuccauccccaacgacaagccguuccagaacgugaaccggaucacguacggggcgugcccccgcuacgucaagcagaacacccugaagcucgccaccggcaugcggaacgugcccgagaagcagacccgcgggaucuucggcgccaucgccggguucaucgagaacggcugggagggcaugguggacgggugguacggcuuccggcaccagaacagcgaggggcgcggccaggccgcggaccugaaguccacgcaggccgccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgggagaacgcggaggacauggggaacggcugcuucaagaucuaccacaagugcgacaacgccugcauccgcuccauccgcaacgggaccuacgaccacgacgucuaccgggacgaggcccucaacaaccgcuuccagaucaagggcguggagcugaaguccggguacaaggacuggauccuguggaucuccuucgccaucagcugcuuccuccugugcguggcccugcucggcuucaucaugugggcgugccagaagggcaacauccggugcaacaucugcaucuga

SEQ ID NO: 63454 - RNA, 1701 nt, Artificial Sequence; identical to SEQ ID NO: 63442
  derived and/or modified sequence opt1 from hemagglutinin__InfluenzaA__ACI26516

SEQ ID NO: 63455 - RNA, 1701 nt, Artificial Sequence; identical to SEQ ID NO: 63443
  derived and/or modified sequence opt1 from hemagglutinin__InfluenzaA__ACI26527

SEQ ID NO: 63456 - RNA, 1701 nt, Artificial Sequence
  derived and/or modified sequence opt1 from hemagglutinin__InfluenzaA__ACI26538
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgacaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 63457 - RNA, 1701 nt, Artificial Sequence
  derived and/or modified sequence opt1 from hemagglutinin__InfluenzaA__ACI26549
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacgagaagugggaccuguucguggagcgcagcaaggccuacuccaacugcuaccccuacgacgugccggacuacgcgagccugcggucccucgucgccagcuccggcacgcuggaguucaucaacgaggacuucaacuggaccggggugacccagagcggcggguccuacagcugcaagcgcggcuccgugaacagcuucuucucccggcugaacuggcuccacgagagcgaguacaaguaccccgcccugaacgucaccaugcccaacaacgggaaguucgacaagcuguacaucuggggcgugcaccaccccuccacggaccgcgagcagaccaagcucuacgugcgggccagcggccgcgucaccgugagcaccaagcggucccagcagacggugaucccgaacaucgggagccgccccuggguccggggccuguccagccgcaucuccaucuacuggaccaucgugaagcccggggacauccugcucaucaacagcaccggcaaccugaucgcgccccggggcuacuucaagauccgcaccgggaaguccagcaucaugcgguccgacgccccgaucggcacgugcagcuccgagugcaucacccccaacgggagcauccccaacgacaagcccuuccagaacgugaacaagaucaccuacggcgccugcccgcgcuacgucaagcagaacacccugaagcucgccacggggaugcggaacgugcccgagaagcagacccgcggcaucuucggcgccaucgcgggguucaucgagaacggcugggaggggaugguggacggcugguacggguuccggcaccagaacuccgagggcaccggccaggccgccgaccugaaguccacccaggccgccaucgaccagaucaacgggaagcugaaccgccucaucgagaagacgaacgagaaguuccaccagaucgagaaggaguucuccgaggucgagggccggauccaggaccuggaggaguacguggaggacaccaagaucgaccuguggagcuacaacgcggagcuccugguggcccuggagaaccagcacaccaucgaccucaccgacuccgagaugaacaagcuguucgagaagacgcgcaagcagcugcgcgagaacgccgaggacauggggaacggcugcuucaagaucuaccacaagugcgacaacgccugcaucgggagcauccggaacggcaccuacgaccacgacgucuaccgcgacgaggcccucaacaaccgguuccagaucaagggcguggagcugaaguccggguacaaggacuggauccuguggaucagcuucgcgaucagcugcuuccuccugugcgucgugcugcucggcuucaucaugugggccugccagaaggggaacauccgcugcaacaucugcaucuga

SEQ ID NO: 63458 - RNA, 1701 nt, Artificial Sequence
  derived and/or modified sequence opt1 from hemagglutinin__InfluenzaA__ACI26560
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacuggaccgggguggcccagagcggcggguccuacgccugcaagcgcggcagcgugaacuccuucuucagccggcugaacuggcuccacgaguccgaguacaaguaccccgcgcugaacgucaccaugcccaacaacgggaaguucgacaagcuguacaucuggggcgugcaccaccccaucaccgaccgcgagcagacgaaccucuacgugcgggccagcggccgcgucaccguguccaccaagcggagccagcagaccgugaucccgaacaucgggagccgccccuggguccggggccuguccagccgcaucuccaucuacuggacgaucgugaagcccggggacauccugcucaucaacagcaccggcaaccugaucgcgccccggggcuacuucaagauccgcaccgggaaguccagcaucaugcgguccgacgccccgaucgggaccugcagcuccgagugcaucacgcccaacggcagcauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacuccgagggcaccggccaggccgccgaccugaaguccacccaggcggccaucgaccagaucaacgggaagcugaaccggcucaucgagaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagacccgcaagcagcugcgggagaacgccgaggacauggggaacggcugcuucaagaucuaccacaagugcgacaacgcgugcaucgggagcauccgcaacggcacguacgaccacgacgucuaccgggacgaggcccucaacaaccgcuuccagaucaagggcguggagcugaaguccggguacaaggacuggauccuguggaucagcuucgccaucuccugcuuccuccugugcgucgugcugcucggcuucaucaugugggccugccagaaggggaacauccggugcaacaucugcaucuga

SEQ ID NO: 63459 - RNA, 1701 nt, Artificial Sequence
  derived and/or modified sequence opt1 from hemagglutinin__InfluenzaA__ACI26571
augaagaccaucaucgcccugagcuacaucuucugccucguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacggcuuccagaacaaggagugggaccuguucguggagcgcagcaaggccuacuccaacugcuaccccuacgacgugccggacuacgcgagccugcggucccucgucgccagcuccggcacgcuggaguucaucaacgaggacuucaacuggaccgggguggcccagagcggcggguccuacgccugcaagcgcggcagcgugaacuccuucuucagccggcugaacuggcuccacgaguccgaguacaaguaccccgcgcugaacgucaccaugcccaacaacgggaaguucgacaagcuguacaucuggggcgugcaccaccccagcaccgaccgcgagcagacgaagcucuacgugcgggccuccggccgcgucaccgugagcaccaagcggagccagcagaccgugaucccgaacaucgggucccgccccuggguccggggccugagcucccgcaucagcaucuacuggacgaucgugaagcccggggacauccugcucaucaacuccaccggcaaccugaucgcgccccggggcuacuucaagauccgcaccggcaagagcuccaucaugcggagcgacgccccgaucgggaccugcuccagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggcgccaucgccggguucaucgagaacggcugggaggggaugguggacggcugguacggguuccgccaccagaacagcgagggcaccggccaggccgccgaccugaaguccacccaggcggccaucgaccagaucaacgggaagcugaaccggcucaucgagaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagacccgcaagcagcugcgggagaacgccgaggacauggggaacggcugcuucaagaucuaccacaagugcgacaacgcgugcaucggguccauccgcaacggcacguacaaccacgacgucuaccgggacgaggcccucaacaaccgcuuccagaucaagggcguggagcugaaguccggguacaaggacuggauccuguggaucuccuucgccaucagcugcuuccuccugugcgucgugcugcucggcuucaucaugugggccugccagaaggggaacauccggugcaacaucugcaucuga

SEQ ID NO: 63460 - RNA, 1701 nt, Artificial Sequence
  derived and/or modified sequence opt1 from hemagglutinin__InfluenzaA__ACI26593
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgaggacuucaacuggaccgggguggcccagagcggcgaguccuacgccugcaagcgcgggagcgugaaguccuucuucagccggcucaacuggcugcacaaguccgacuacaaguaccccgcgcugaacgucaccaugcccaacaacggcaaguucgacaagcucuacaucuggggcgugcaccaccccagcacggaccgcgagcagaccucccuguacgugcgggccagcgggcgcgucaccgugagcaccaagcggucccagcagacggugaucccgaacaucggcagccgccccuggguccgggggcuguccagccgcaucuccaucuacuggaccaucgugaagcccggcgacauccuccugaucaacagcaccgggaaccugaucgcgccccggggcuacuucaagauccgcaccggcaaguccagcaucaugcgguccgacgccccgaucgggacgugcagcuccgagugcaucacccccaacggcagcauccccaacgacaagcccuuccagaacgugaaccgcaucaccuacggggccugcccgcgguacgucaagcagaacacccucaagcuggccacgggcaugcgcaacgugcccgagaagcagacccgggggaucuucggcgccaucgccggcuucaucgagaacgggugggagggcaugguggacgggugguacggcuuccgccaccagaacuccgaggggaccggccaggccgccgaccugaaguccacccaggcggccaucgaccagaucaacggcaagcucaaccggcugaucgagaagacgaacgagaaguuccaccagaucgagaaggaguucuccgaggucgaggggcgcauccaggaccuggagaaguacguggaggacaccaagaucgaccucuggagcuacaacgccgagcugcugguggcccucgagaaccagcacaccaucgaccugaccgacuccgagaugaacaagcuguucgagaagacgcgcaagcagcuccgggagaacgccgaggacaugggcaacgggugcuucaagaucuaccacaagugcgacaacgcgugcaucggcagcauccgcaacgggaccuacgaccacgacgucuaccgggacgaggcccugaacaaccgcuuccagaucaagggcguggagcugaaguccggcuacaaggacuggauccucuggaucagcuucgccaucagcugcuuccugcugugcgucgugcuccugggguucaucaugugggccugccagaagggcaacauccggugcaacaucugcaucuga

SEQ ID NO: 63461 - RNA, 1698 nt, Artificial Sequence
  derived and/or modified sequence opt1 from hemagglutinin__InfluenzaA__ACI32715
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacaccgugaucgagaagaugaacacgcaguucaccgccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggacguacgacuaccccaaguacuccgaggagagcaagcucaaccgcgagaagaucgacggcgugaagcuggaguccaugggcguguaccagauccuggccaucuacagcaccgucgccagcucccucgugcugcuggugagccucggggccaucuccuucuggaugugcagcaacggcucccugcagugccggaucugcaucuga

SEQ ID NO: 63462 - RNA, 1698 nt, Artificial Sequence
  derived and/or modified sequence opt1 from hemagglutinin__InfluenzaA__ACI32716
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacggucgccuccagccucgugcugcuggugucccucggggccaucagcuucuggaugugcuccaacggcagccugcagugcaccaucugcaucuga

SEQ ID NO: 63463 - RNA, 1698 nt, Artificial Sequence
  derived and/or modified sequence opt1 from hemagglutinin__InfluenzaA__ACI32717
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaugaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacggucgccuccagccucgugcugcuggugucccucggggccaucaacuucuggaugugcagcaacggcucccugcagugcaagaucugcaucuga

SEQ ID NO: 63464 - RNA, 1698 nt, Artificial Sequence
  derived and/or modified sequence opt1 from hemagglutinin__InfluenzaA__ACI32718
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgccaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgcgaagcgccccaaggugcgggaccaggagggccgcaucaacuacuacuggacccuccuggagcccggggacaccaucaucuucgaggccaacggcaaccugaucgccccgcgguucgccuucgcccucucccgcggguucggcagcggcaucaucacguccaacgcgcccauggacgagugcgacgccaagugccagacgccccagggggccaucaacagcucccugcccuuccagaacgugcacccggucaccaucggcgagugccccaaguacgugcggagcgccaagcugcgcauggccaccgggcuccggaacauccccuccauccagagccgcggccuguucggggcgaucgccggcuucaucgagggcggguggaccggcaugguggacgggugguacggcuaccaccaccagaacgagcagggguccggcuacgccgccgaccagaaguccacccagaacgccaucaacggcaucaccaacaaggucaacagcgugaucgagaagaugaacacccaguucacggcgguggggaaggaguucagcaagcuggagcggcgcauggagaaccucaacaagaaggucgacgacggcuuccuggacaucuggaccuacaacgccgagcugcucgugcugcuggagaacgagcggacccucgacuuccacgacuccaacgucaagaaccuguacgagaaggucaagagccagcugaagaacaacgccaaggagguggggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacggucgccuccagccucgugcugcuggugucccucggggcgaucagcuucuggaugugcuccaacggcagccugcagugcaccaucugcaucuga

SEQ ID NO: 63465 - RNA, 1698 nt, Artificial Sequence; identical to SEQ ID NO: 63462
  derived and/or modified sequence opt1 from hemagglutinin__InfluenzaA__ACI32719

SEQ ID NO: 63466 - RNA, 1698 nt, Artificial Sequence; identical to SEQ ID NO: 63462
  derived and/or modified sequence opt1 from hemagglutinin__InfluenzaA__ACI32720

SEQ ID NO: 63467 - RNA, 1698 nt, Artificial Sequence
  derived and/or modified sequence opt1 from hemagglutinin__InfluenzaA__ACI32721
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucuccuacuacuggacccuccuggagcccggggacaccaucaucuucgaggcgaacggcaaccugaucgccccgcgguucgccuucgcccucagccgcggguucggcuccggcaucaucacgagcaacgcccccauggacgagugcgacgcgaagugccagacgccccagggggccaucaacuccagccugcccuuccagaacguccacccggugaccaucggcgagugccccaaguacgugcgguccgccaagcugcgcauggccaccgggcuccggaacauccccagcauccagucccgcggccuguucggggccaucgcgggcuucaucgagggcggguggaccggcauggucgacgggugguacggcuaccaccaccagaacgagcaggggagcggcuacgccgccgaccagaaguccacccagaacgccaucaacggcaucaccaacaaggugaacagcgugaucgagaagaugaacacccaguucacggccgucgggaaggaguucuccaagcuggagcggcgcauggagaaccucaacaagaagguggacgacggcuuccuggacaucuggaccuacaacgcggagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcucaaccgcgagaagaucgacggcgugaagcuggagagcaugggcguguaccagauccuggccaucuacuccacggucgccagcucccucgugcugcuggugagccucggggccaucuccuucuggaugugcagcaacggcucccugcagugccggaucugcaucuga

SEQ ID NO: 63468 - RNA, 1698 nt, Artificial Sequence; identical to SEQ ID NO: 63462
  derived and/or modified sequence opt1 from hemagglutinin__InfluenzaA__ACI32722

SEQ ID NO: 63469 - RNA, 1698 nt, Artificial Sequence
  derived and/or modified sequence opt1 from hemagglutinin__InfluenzaA__ACI32723
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacggucgccuccagccucgugcugcuggugucccucggggccaucagcuucuggaugugcuccaacggcagccugcagugccggaucugcuucuga

SEQ ID NO: 63470 - RNA, 1698 nt, Artificial Sequence
  derived and/or modified sequence opt1 from hemagglutinin__InfluenzaA__ACI32724
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccugaagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucagcaagcuggagcggcgcauggagaaccucaacaagaagguggacgacggcuuccuggacaucuggaccuacaacgcggagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacggucgccuccagccucgugcugcuggugucccucggggccaucagcuucuggaugugcuccaacggcagccugcagugcaagaucugcaucuga

SEQ ID NO: 63471 - RNA, 1698 nt, Artificial Sequence; identical to SEQ ID NO: 62393
  derived and/or modified sequence opt1 from hemagglutinin__InfluenzaA__ACI32725

SEQ ID NO: 63472 - RNA, 1698 nt, Artificial Sequence
  derived and/or modified sequence opt1 from hemagglutinin__InfluenzaA__ACI32726
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggccaccgggcuccggaacauccccuccauccagagccgcggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacccaguucacggccgucgggaaggaguucagcaagcuggagaagcggauggagaaccucaacaagaagguggacgacggcuuccuggacaucuggaccuacaacgcggagcugcucguccugcuggagaacgagcgcacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgggagaagaucgacggcgugaagcuggagagcaugggcaucuaccagauccuggccaucuacagcacggugaccuccagccucguccugcuggugucccucggggccaucagcuucuggaugugcuccaacggcagccugcagugccgcaucugcaucuga

SEQ ID NO: 63473 - RNA, 1698 nt, Artificial Sequence
  derived and/or modified sequence opt1 from hemagglutinin__InfluenzaA__ACI32727
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcaucuccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacaucggggaccagcgggcccuguaccacacggagaacgccuacgugagcguggucagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacgugcacccggucaccaucggcgagugccccaaguacgugcggagcgccaagcugcgcauggccaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggucaacagcgugaucgagaagaugaacacccaguucacggccguggggaaggaguucagcaagcuggagcggcgcauggagaaccucaacaagaaggucgacgacggcuuccuggacaucuggaccuacaacgcggagcugcucgugcugcuggagaacgagcggacccucgacuuccacgacuccaacgucaagaaccuguacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcucaaccgcgagaagaucgacggcgugaagcuggagagcaugggcguguaccagauccuggccaucuacagcacgguggccuccagccucguccugcuggugacccucggggccaucuccuucuggaugugcagcaacggcucccugcagugcaccaucugcaucuga

SEQ ID NO: 63474 - RNA, 1698 nt, Artificial Sequence
  derived and/or modified sequence opt1 from hemagglutinin__InfluenzaA__ACI32729
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugauccccaaggagagcugguccuacaucguggagacccccaaccccgagaacggcacgugcuacccgggcuacuucgccgacuacgaggagcugcgcgagcagcucagcuccgugagcuccuucgagcgguucgagaucuuccccaaggagagcuccuggcccaaccacaccgucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggggaccagcgggcccuguaccacacggagaacgccuacguguccgucgugagcagccacuacucccgccgguucacccccgagaucgccaagcgccccaaggugcgggaccaggagggccgcaucaacuacuacuggacccuccuggagccgggggacaccaucaucuucgaggcgaacggcaaccugaucgcgccccgguucgccuucgcccucagccgcggguucggcuccggcaucaucacgagcaacgcccccauggacgagugcgacgccaagugccagacgccccagggggccaucaacuccagccugccguuccagaacguccaccccgugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcgugaccaacaaggucaacagcgugaucgagaagaugaacacccaguucacggccgucgggaaggaguucaacaagcuggagcggcgcauggagaaccucaacaagaagguggacgacggcuuccuggacaucuggaccuacaacgccgagcugcucgugcugcuggagaacgagcggacccucgacuuccacgacuccaacgucaagaaccuguacgagaaggucaagagccagcugaagaacaacgcgaaggagaucgggaacggcugcuucgaguucuaccacaagugcaacgacgagugcauggaguccgugaagaacgggaccuacgacuacccgaaguacagcgaggaguccaagcucaaccgcgagaagaucgacggcgugaagcuggagagcaugggcguguaccagauccuggccaucuacuccacgguggccagcagccucguccugcuggugucccucggggccaucagcuucuggaugugcuccaacggcagccugcagugccggaucugcaucuga

SEQ ID NO: 63475 - RNA, 1698 nt, Artificial Sequence; identical to SEQ ID NO: 63474
  derived and/or modified sequence opt1 from hemagglutinin__InfluenzaA__ACI32730

SEQ ID NO: 63476 - RNA, 1698 nt, Artificial Sequence
  derived and/or modified sequence opt1 from hemagglutinin__InfluenzaA__ACI32731
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccgcaaguucaaccccgagaucgccaagcggcccaaggugcgcgaccaggagggccggaucaacuacuacuggacgcuccuggagcccggggacaccaucaucuucgaggcgaacggcaaccugaucgccccgcgcuacgccuucgcccucucccggggguucggcagcggcaucaucaacuccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuucaucgacaucuggaccuacaacgccgagcugcuggugcuccuggagaacgagcgcacccuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggacguacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugcaagaucugcaucuga

SEQ ID NO: 63477 - RNA, 1698 nt, Artificial Sequence
  derived and/or modified sequence opt1 from hemagglutinin__InfluenzaA__ACI32732
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcacgguggccagcucccucgugcugcuggucagccucggggccaucuccuucuggaugugcagcaacggcucccugcagugcaccaucugcaucuga

SEQ ID NO: 63478 - RNA, 1698 nt, Artificial Sequence
  derived and/or modified sequence opt1 from hemagglutinin__InfluenzaA__ACI32733
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcaagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccgcaaguucaacuccgagaucgccaagcggcccaaggugcgcgaccaggagggccggaucaacuacuacuggacgcuccuggagcccggggacaccaucaucuucgaggcgaacggcaaccugaucgcgccccgcuacgccuucgcccucagccggggguucggcuccggcaucaucaacagcaacgccccgauggacgagugcgacgccaagugccagacgccccagggggccaucaacuccagccugcccuuccagaacguccaccccgugaccaucggcgagugcccgaaguacgugcgcuccgccaagcugcggauggucaccgggcuccgcaacauccccagcauccagucccggggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuucaucgacaucuggaccuacaacgccgagcugcuggugcuccuggagaacgagcgcacccuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggacguacgacuaccccaaguacagcgaggaguccaagcugaaccgggagaagaucgacggcgugaagcucgagagcaugggcgucuaccagauccuggccaucuacagcaccguggccuccagccuggugcuccuggucucccugggggccaucagcuucuggaugugcuccaacggcagccuccagugcaccaucugcaucuga

SEQ ID NO: 63479 - RNA, 1698 nt, Artificial Sequence
  derived and/or modified sequence opt1 from hemagglutinin__InfluenzaA__ACI32734
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcaaguccuacgccaacaacaagaagaaggaggugcucguccuguggggcgugcaccacccgcccaacaucggggaccagaaggcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgcgcuucgccuucgcccucucccggggguucggcagcggcaucaucacguccaacgcccccauggacgagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgggagaagaucgacggcgugaagcuggaguccaugggcgucuaccagauccuggccaucuacagcacgguggccagcucccucgugcugcuggucagccucggggccaucuccuucuggaugugcagcaacggcucccugcagugcaccaucugcaucuga

SEQ ID NO: 63480 - RNA, 1698 nt, Artificial Sequence
  derived and/or modified sequence opt1 from hemagglutinin__InfluenzaA__ACI32736
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacggccaccggggucuccgccagcugcucccacaacggcaagagcuccuucuacaagaaccugcuguggcucaccgggaagaacggccuguaccccaaccugagcaaguccuacgccaacaacaaggagaaggaggugcucgugcuguggggcguccaccacccgcccaacaucggcgaccagcgggcccuguaccacaccgagaacgccuacgugagcguggucagcucccacuacagccgcaaguucacgcccgagaucgcgaagcggcccaaggugcgcgaccaggagggccggaucaacuacuacuggacccuccuggagcccggggacaccaucaucuucgaggccaacggcaaccugaucgccccgcgcuacgccuucgcccucucccggggguucggcagcggcaucaucaacuccaacgcgcccauggacgagugcgacgccaagugccagacgccccagggggccaucaacagcucccugcccuuccagaacgugcacccggucaccaucggcgagugccccaaguacgugcgcagcgccaagcugcggauggugaccgggcuccgcaacauccccuccauccagagccggggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucacgaacaaggugaacagcgugaucgagaagaugaacacccaguucaccgccgucgggaaggaguucaacaagcuggagcgccggauggagaaccucaacaagaagguggacgacggcuucaucgacaucuggaccuacaacgcggagcugcugguccuccuggagaacgagcgcacgcuggacuuccacgacagcaacgugcggaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccaugggcguguaccagauccuggccaucuacagcaccgucgccagcucccuggugcuccuggugagccugggggccaucuccuucuggaugugcagcaacggcucccuccagugccggaucugcaucuga

SEQ ID NO: 63481 - RNA, 1698 nt, Artificial Sequence
  derived and/or modified sequence opt1 from hemagglutinin__InfluenzaA__ACI32737
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugauccccaaggagagcugguccuacaucguggagauccccaaccccgagaacgggaccugcuacccgggcuacuucgccgacuacgaggagcugcgcgagcagcucagcuccgugagcuccuucgagcgguucgagaucuuccccaaggagagcuccuggcccaaccacacggucaccggggugagcgccuccugcagccacaacggcaaguccagcuucuaccgcaaccugcuguggcucaccgggaagaacggccuguaccccaaccuguccaagagcuacgccaacaacaaggagaaggaggugcucguccuguggggcgugcaccacccgcccaacaucggcgaccagcgggcccuguaccacaccgagaacgccuacguguccgucgugagcagccacuacucccgccgguucacgcccgagaucgccaagcgccccaaggugcgggaccaggagggccgcaucaacuacuacuggacccuccuggagccgggggacaccaucaucuucgaggcgaacggcaaccugaucgcgccccgguucgccuucgcccucagccgcgggcugggcuccggcaucaucaccagcaacgcccccauggacgagugcgacgccaagugccagacgccccagggggccaucaacuccagccugccguuccagaacguccaccccgugaccaucggcgagugccccaaguacgugcgguccgccaagcuccgcauggucaccgggcugcggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacgcagaacgccaucaacggcaucaccaacaaggugaacagcgucaucgagaagaugaacacccaguucaccgccguggggaaggaguucaacaagcucgagcggcgcauggagaaccugaacaagaaggucgacgacggcuuccuggacaucuggacguacaacgccgagcuccuggugcugcucgagaacgagcggacccuggacuuccacgacuccaacgugaagaaccuguacgagaaggucaagagccagcuccgcaacaacgcgaaggagaucgggaacggcugcuucgaguucuaccacaagugcaacgacgagugcauggaguccgugaagaacgggaccuacgacuacccgaaguacagcgaggaguccaagcugaaccgggagaagaucgacggcgugaagcuggagagcaugggcgucuaccagauccucgccaucuacuccaccguggccagcagccuggugcugcucgucucccugggggccaucagcuucuggaugugcuccaacggcagccugcagugccgcaucugcaucuga

SEQ ID NO: 63482 - RNA, 1698 nt, Artificial Sequence
  derived and/or modified sequence opt1 from hemagglutinin__InfluenzaA__ACI32739
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucgggaaccagcggacgcuguaccacaccgagaacgccuacgucagcguggugagcucccacuacagccgccgguucacccccgagaucaccaagcgccccaagguccgggaccaggagggccgcaucaacuacuacuggacgcuccuggagcccggggacaccaucaucuucgaggccaacggcaaccugaucgccccgugguacgcguucgcccucucccggggguucggcagcggcaucaucaccuccaacgcccccauggacgagugcgacgccaagugccagacgccccagggggccaucaacagcucccugcccuuccagaacgugcacccggugaccaucggcgagugccccaaguacguccgcagcgcgaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacccagaacgcgaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgccgagcugcucgugcugcuggagaacgagcgcacgcucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgucaagcuggaguccaugggcguguaccagauccuggccaucuacagcaccguggcgagcucccucguccugcuggugagccucggggccaucuccuucuggaugugcagcaacggcucccugcagugcaagaucugcaucuga

SEQ ID NO: 63483 - RNA, 1698 nt, Artificial Sequence
  derived and/or modified sequence opt1 from hemagglutinin__InfluenzaA__ACI32740
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaagcacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucagcguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagagcaagcucaaccgggagaagaucgacggcgucaagcuggacuccaugggcguguaccagauccuggcgaucuacagcaccguggccagcucccucguccugcuggugagccucggggccaucuccuucuggaugugcccgaacggcagccugcagugcaccaucugcaucuga

SEQ ID NO: 63484 - RNA, 1698 nt, Artificial Sequence
  derived and/or modified sequence opt1 from hemagglutinin__InfluenzaA__ACI32741
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaaggaguccagcuggcccaagcacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacccuguaccacacggagaacgccuacgucagcguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagagcaagcucaaccgggagaagaucgacggcgucaagcuggacuccaugggcguguaccagauccuggcgaucuacagcaccguggccagcucccucguccugcuggugagccucggggccaucuccuucuggaugugcccgaacggcagccugcagugcaagaucugcaucuga

SEQ ID NO: 63485 - RNA, 1698 nt, Artificial Sequence
  derived and/or modified sequence opt1 from hemagglutinin__InfluenzaA__ACI32742
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucggggaccagcggacgcuguaccacaccgagaacgccuacgucagcguggugagcucccacuacagccgccgguucacccccgagaucaccaagcgccccaagguccgggaccaggagggccgcaucaacuacuacuggacgcuccuggagcccggggacaccaucaucuucgaggccaacggcaaccugaucgccccgugguacgcguucgcccucucccggggguucggcagcggcaucaucaccuccaacgcccccauggacgagugcgacgccaagugccagacgccccagggggccaucaacagcucccugcccuuccagaacgugcacccggugaccaucggcgagugccccaaguacguccgcagcgcgaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgccgaccagaaguccacccagaacgcgaucaacggcaucacgaacaaggucaacagcgugaucgagaagaugaacacccaguucaccgccguggggaaggaguucaacaagcuggagcgccggauggagaaccucaacaagaaggucgacgacggcuuccuggacaucuggaccuacaacgccgagcugcucgugcugcuggagaacgagcgcacgcucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggaccuacgacuaccccaaguacuccgaggagagcaagcucaaccgggagaagaucgacggcgucaagcuggacuccaugggcguguaccagauccuggccaucuacagcaccguggcgagcucccucguccugcuggugagccucggggccaucuccuucuggaugugcagcaacggcucccugcagugcaagaucugcaucuga

SEQ ID NO: 63486 - RNA, 1698 nt, Artificial Sequence
  derived and/or modified sequence opt1 from hemagglutinin__InfluenzaA__ACI32743
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcgccugcuaccccggcuacuucgccgacuacgaggagcugcgcgagcagcucuccagcguguccagcuucgagcgguucgagaucuucccgaagaaguccagcuggcccaaccacacggugaccggggucuccgccagcugcucccacaacggcaagagcuccuucuaccgcaaccugcuguggcucaccgggaagaacggccuguaccccaaccugagcaaguccuacgccaacaacaaggagaaggaggugcucauccuguggggcgugcaccacccgcccaacaucgggaaccagcggacccuguaccacacggagaacgccuacgucagcguggugagcucccacuacagccgccgguucacccccgagaucaccaagcgccccaagguccgggaccaggagggccgcaucaacuacuacuggacccuccuggagcccggggacacgaucaucuucgaggccaacggcaaccugaucgcgccgugguacgccuucgcccucucccggggguucggcagcggcaucaucaccuccaacgcccccauggacgagugcgacgccaagugccagacgccccagggggcgaucaacagcucccugcccuuccagaacgugcacccggugaccaucggcgagugccccaaguacguccgcagcgccaagcugcggauggugaccgggcuccgcaacauccccuccauccagagccggggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuaccccaaguacuccgaggagagcaagcucaaccgggagaagaucgacggcgucaagcuggacuccaugggcguguaccagauccuggcgaucuacagcaccguggccagcucccucguccugcuggugagccucggggccaucuccuucuggaugugcagcaacggcucccugcagugccgcaucugcaucuga

SEQ ID NO: 63487 - RNA, 1701 nt, Artificial Sequence
  derived and/or modified sequence opt1 from hemagglutinin__InfluenzaA__ACJ09818
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagguggaggucacgaacgccaccgagcuggugcagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgucccggacuacgcgagccugcggucccucguggccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucuuccuguacgcgcaggccagcgggcggaucaccguguccacgaagcgcagccagcagaccgucaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaaggggguggagcugaaguccggcuacaaggacuggauccuguggaucuccuucgccaugagcugcuuccuccugugcgucgcccugcucggcuucaucaugugggccugccagaaggggaacauccgcugcaacaucugcaucuga

SEQ ID NO: 63488 - RNA, 1683 nt, Artificial Sequence
  derived and/or modified sequence opt1 from hemagglutinin__InfluenzaA__ACJ67533
auggagaccaucagccugaucaccauccuccugguggucacggccuccaacgccgacaagaucugcaucggccaccagagcaccaacuccaccgagaccguggacacgcugaccgagaccaacgugcccgucacccacgcgaaggagcuccugcacacggagcacaacgggaugcugugcgccaccagccucggccacccgcugauccuggacacgugcaccaucgaggggcucguguacggcaaccccuccugcgaccugcugcucgaggggcgcgaguggagcuacaucguggagcgguccagcgccgucaacgggaccugcuaccccggcaacguggagaaccuggaggagcugcgcacccucuucuccagcgccuccagcuaccagcggauccagaucuuccccgacaccaccuggaacgugacguacaccggcaccucccgcgccugcagcggcuccuucuaccggagcaugcgcuggcugacccagaaguccggguucuacccgguccaggacgcgcaguacacgaacaaccggggcaagagcauccuguucgugugggggauccaccacccgcccaccuacgccgagcagaccaaccucuacauccgcaacgacaccacgaccuccgugaccaccgaggaccugaaccggacguucaagcccgucaucggcccccgcccccuggugaacggccuccaggggcggaucgacuacuacuggagcgugcugaagcccggccagacccugcgcguccggagcaacgggaaccucaucgcccccugguacggccacgugcuguccggcgggagccacggccgcauccugaagaccgaccucaaguccgggagcugcgugguccagugccagaccgagaagggcgggcugaacuccacgcugccguuccacaacaucagcaaguacgccuucgggaccugccccaaguacgugcgggugaacucccucaagcuggcggucggccugcgcaacgugcccgcccggagcucccgcggccucuucggcgccaucgccggguucaucgagggcggguggcccggccugguggccggcugguacggguuccagcacagcaacgaccagggcgucgggauggcggccgaccgggacuccacccagaaggccaucgacaagaucaccagcaaggugaacaacaucgucgacaagaugaacaagcaguacgagaucaucgaccacgaguucuccgagguggagacgcgccugaacaugaucaacaacaagaucgacgaccagauccaggacgugugggccuacaacgccgagcuccugguccugcucgagaaccagaagacccuggacgagcacgacgcgaacgugaacaaccuguacaacaaggugaagcgggcccucggcagcaacgccauggaggacgggaagggcugcuucgagcuguaccacaagugcgacgaccagugcauggagaccauccgcaacggcaccuacaaccgccggaaguaccgcgaggagucccggcuggagcgccagaagaucgagggggucaagcucgagagcgagcggaccuacaagauccugacgaucuacuccaccguggccagcucccuggugcucgccaugggcuucgcggccuuccuguucugggccaugagcaacgggagcugccgcugcaacaucugcaucuga

SEQ ID NO: 63489 - RNA, 1704 nt, Artificial Sequence
  derived and/or modified sequence opt1 from hemagglutinin__InfluenzaA__ACJ68607
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugggggacugcuccgucgccggcuggcugcucgggaacccgaugugcgacgaguucaucaacgugcccgaguggagcuacaucguggagaaggccaaccccgccaacgaccugugcuaccccggcaacuucaacgacuacgaggagcugaagcaccuccugucccgcaucaaccacuucgagaagauccagaucauccccaagagcuccuggagcgaccacgaggccuccagcggcgucuccagcgcgugcccguaccaggggacccccuccuucuuccggaacgugguguggcugaucaagaagaacaacacguaccccaccaucaagcgcagcuacaacaacaccaaccaggaggaccuccugauccuguggggcauccaccacuccaacgacgccgccgagcagaccaagcucuaccagaacccgacgaccuacaucagcgucgggaccuccacccugaaccagcggcuggugcccaagaucgccacgcgcagcaaggugaacggccaguccgggcggauggacuucuucuggaccauccucaagcccaacgacgcgaucaacuucgagagcaacggcaacuucaucgcccccgaguacgccuacaagaucgucaagaagggcgacagcgccaucaugaaguccgagguggaguacgggaacugcaacaccaagugccagaccccgaucggcgccaucaacagcuccaugcccuuccacaacauccacccccugacgaucggggagugccccaaguacgucaagagcaacaagcuggugcucgcgaccggccugcgcaacuccccgcugcgggagcgccggcgcaagcggggccucuucggggccaucgccggcuucaucgagggcggguggcaggggaugguggacggcugguacggcuaccaccacagcaacgagcagggguccggcuacgccgccgacaaggagagcacccagaaggcgaucgacggggugaccaacaaggucaacuccaucaucgacaagaugaacacgcaguucgaggccgugggccgcgaguucaacaaccuggagcggcgcaucgagaaccugaacaagaagauggaggacggguuccucgacguguggaccuacaacgccgagcugcugguccucauggagaacgagcggacccuggacuuccacgacagcaacgugaagaaccuguacgacaagguccgccuccagcugcgggacaacgccaaggagcugggcaacggcugcuucgaguucuaccacaagugcgacaacgagugcauggaguccgugcgcaacgggaccuacgacuacccccaguacagcgaggaggcccggcucaagcgcgaggagaucuccggcgugaagcuggagagcaucgggacguaccagauccuguccaucuacagcaccgucgcguccagccucgcccuggccaucaugguggccggccugucccucuggaugugcagcaacgggagccugcagugccggaucugcaucuga

SEQ ID NO: 63490 - RNA, 1704 nt, Artificial Sequence
  derived and/or modified sequence opt1 from hemagglutinin__InfluenzaA__ACJ68609
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugguguggcugaucaagaagaacaacacguaccccaccaucaagcggagcuacaacaacaccaaccaggaggaccuccugauccugugggggauccaccacuccaacgacgccgccgagcagaccaagcucuaccagaacccgacgaccuacaucagcgucggcaccuccacccugaaccagcgccuggugcccaagaucgccacgcggagcaaggugaacgggcaguccggccgcauggacuucuucuggaccauccucaagcccaacgacgcgaucaacuucgagagcaacgggaacuucaucgcccccgaguacgccuacaagaucgucaagaagggcgacagcgccaucaugaaguccgagguggaguacggcaacugcaacaccaagugccagaccccgaucggggccaucaacagcuccaugcccuuccacaacauccacccccugacgaucggcgagugccccaaguacgucaagagcaacaagcuggugcucgcgaccgggcugcggaacuccccgcugcgcgagcggcgccggaagcgcggccucuucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggucaacuccaucaucgacaagaugaacacgcaguucgaggccguggggcgggaguucaacaaccuggagcgccggaucgagaaccugaacaagaagauggaggacggcuuccucgacguguggaccuacaacgccgagcugcugguccucauggagaacgagcgcacccuggacuuccacgacagcaacgugaagaaccuguacgacaagguccggcuccagcugcgcgacaacgccaaggagcuggggaacggcugcuucgaguucuaccacaagugcgacaacgagugcauggaguccgugcggaacggcaccuacgacuacccccaguacagcgaggaggcccgccuccggcgcgaggagaucuccggggugaagcuggagagcaucggcacguaccagauccuguccaucuacagcaccgucgcguccagccucgcccuggccaucaugguggccgggcugucccucuggaugugcagcaacggcagccugcagugccgcaucugcaucuga

SEQ ID NO: 63491 - RNA, 1704 nt, Artificial Sequence
  derived and/or modified sequence opt1 from hemagglutinin__InfluenzaA__ACJ68610
auggagaagaucgugcuguuccucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgugaagccccugauccuccgcgacugcuccgucgccggguggcugcugggcaacccgaugugcgacgaguucaucaacgugcccgaguggagcuacaucguggagaaggccaaccccgccaacgaccucugcuaccccgggaacuucaacgacuacgaggagcugaagcaccuccugucccggaucaaccacuucgagaagauccagaucauccccaagagcuccuggagcgaccacgaggccuccagcggcgucuccagcgcgugcccguaccagggcacccccuccuucuuccgcaacgugguguggcugaucaagaagaacaacacguaccccaccaucaagcggagcuacaacaacaccaaccaggaggaccugcucauccugugggggauccaccacuccaacgacgccgccgagcagaccaagcuguaccagaacccgacgaccuacaucagcgucggcaccuccacccucaaccagcgccuggugcccaagaucgccacgcggagcaaggugaacgggcaguccggccgcauggacuucuucuggaccauccugaagcccaacgacgcgaucaacuucgagagcaacgggaacuucaucgcccccgaguacgccuacaagaucgucaagaagggcgacagcgccaucaucaaguccgagguggaguacggcaacugcaacaccaagugccagaccccgaucggggccaucaacagcuccaugcccuuccacaacauccacccccucacgaucggcgagugccccaaguacgucaagagcaacaagcuggugcuggcgaccgggcuccggaacuccccgcugcgcgagcggcgccggaagcgcggccuguucggcgccaucgccggguucaucgagggcggguggcagggcaugguggacgggugguacggcuaccaccacagcaacgagcagggcuccggguacgccgccgacaaggagagcacccagaaggcgaucgacggcgugaccaacaaggucaacuccaucaucgacaagaugaacacgcaguucgaggccguggggcgggaguucaacaaccucgagcgccggaucgagaaccugaacaagaagauggaggacggcuuccuggacguguggaccuacaacgccgagcuccugguccugauggagaacgagcgcacccucgacuuccacgacagcaacgugaagaaccuguacgacaagguccggcugcagcuccgcgacaacgccaaggagcuggggaacggcugcuucgaguucuaccacaagugcgacaacgagugcauggaguccgugcggaacggcaccuacgacuacccccaguacagcgaggaggcccgccugaagcgggaggagaucuccggggugaagcucgagagcaucggcacguaccagauccuguccaucuacagcaccgucgcguccagccuggcccucgccaucaugguggccgggcugucccuguggaugugcagcaacggcagccuccagugccgcaucugcaucuga

SEQ ID NO: 63492 - RNA, 1704 nt, Artificial Sequence
  derived and/or modified sequence opt1 from hemagglutinin__InfluenzaA__ACJ68611
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggagcgaccacgaggccucccugggcgucagcuccgcgugcccguaccagggcaugcccagcuucuuccgcaacgugguguggcucaucaagaagaacaacaccuaccccacgaucaagcgguccuacaacaacaccaaccaggaggaccugcugauccucugggggauccaccacagcaacgacgccgccgagcagaccaagcuguaccagaacccgaccacguacaucuccgucggcaccagcacccugaaccagcgccucgugcccaagaucgccacccgguccaaggugaacgggcagagcggccgcauggacuucuucuggacgauccugaagcccaacgacgcgaucaacuucgaguccaacgggaacuucaucgcccccgaguacgccuacaagaucgucaagaagggcgacagcgccaucaugaaguccgaggugggcuacgggaacugcaacaccaagugccagaccccgaucggcgccaucaacagcagcaugcccuuccacaacauccacccccugaccaucggggagugccccaaguacgugaaguccaacaagcucguccuggcgacgggccugcggaacagcccgcuccgcgagcggcgccggaagcgcggccuguucggggccaucgccggcuucaucgagggcggguggcaggggaugguggacggcugguacggcuaccaccacuccaacgagcaggggagcggcuacgccgccgacaaggaguccacccagaaggcgaucgacggggugaccaacaaggucaacagcaucaucgacaagaugaacacccaguucgaggccgugggccgggaguucaacaaccuggagcgccggaucgagaaccucaacaagaagauggaggacggguuccuggacguguggacguacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccacaagugcgacgacgagugcauggagagcgugcggaacgggaccuacgacuacccccaguacuccgaggaggcccgccugaagcgggaggagaucagcggcgugaagcuggaguccaucgggaccuaccagauccucagcaucuacuccacggucgcgagcucccuggcccuggccaucaugguggccggccucagccuguggaugugcuccaacgggagccugcagugccgcaucugcaucuga

SEQ ID NO: 63493 - RNA, 1704 nt, Artificial Sequence
  derived and/or modified sequence opt1 from hemagglutinin__InfluenzaA__ACJ68612
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguucaucaacgugcccgaguggagcuacaucguggagaaggccaaccccgccaacgaccugugcuaccccgggaacuucaacgacuacgaggagcugaagcaccuccugucccggaucaaccacuucgagaagauccagaucauccccaagagcuccuggccggaccacgaggccagcuccggcgucagcuccgcgugccccuaccagggcacccccagcuucuuccgcaacgugguguggcugaucaagaagaacaacacguacccgaccaucaagcgguccuacaacaacaccaaccaggaggaccuccugauccugugggggauccaccacagcaacaacgccgccgagcagaccaagcucuaccagaaccccacgaccuacaucuccgucggcaccagcacccugaaccugcgccucgugcccaagaucgccacgcgguccaaggugaacgggcagagcggccgcauggacuucuucuggaccauccugaagcccaacgacgcgaucaacuucgaguccaacgggaacuucaucgccccggaguacgccuacaagaucgucaagaagggcgacagcgccaucaugaaguccgagguggaguacggcaacugcaacaccaagugccagacccccaucggggccaucaacagcagcaugcccuuccacaacauccacccccugacgaucggcgagugcccgaaguacgugaaguccaacaagcucguccuggcgaccgggcugcggaacagcccccuccgcgagcggcgccggaagcgcggccuguucggcgccaucgccggguucaucgagggcggguggcagggcaugguggacgggugguacggcuaccaccacuccaacgagcagggcagcggguacgccgccgacaaggaguccacccagaaggcgaucgacggcgugaccaacaaggucaacagcaucaucgacaagaugaacacgcaguucgaggccguggggcgggaguucaacaaccuggagcgccggaucgagaaccucaacaagaagauggaggacggcuuccuggacguguggaccuacaacgccgagcugcucguccugauggagaacgagcgcacccuggacuuccacgacuccaacgugaagaaccucuacgacaagguccggcugcagcugcgcgacaacgccaaggagcucgggaacggcugcuucgaguucuaccacaagugcgacaacgagugcauggagagcgugcggaacggcaccuacgacuacccccaguacuccgaggaggcccgccugaagcgggaggagaucagcggggugaagcuggaguccaucggcgcguaccagauccucagcaucuacuccacggucgccagcucccuggcccuggccaucaugguggccgggcucagccuguggaugugcuccaacggcagccugcagugccgcaucugcaucuga

SEQ ID NO: 63494 - RNA, 1704 nt, Artificial Sequence
  derived and/or modified sequence opt1 from hemagglutinin__InfluenzaA__ACJ68613
auggagaagaucgugcuguuccucgccaucgucagccacgugaaguccgaccagaucugcaucggcuaccacgccaacaacagcaccgagcaggucgacaccaucauggagaagaacgugacggugacccacgcgcaggacauccuggagaagacccacaacgggaagcugugcgaccucggcggggugaagccccugauccugcgcgacugcuccgucgccggcuggcuccuggggaacccgaugugcgacgaguucaucaacgugcccgaguggagcuacaucguggagaaggccaaccccgccaacgaccugugcuaccccggcaacuucaacgacuacgaggagcucaagcaccuccugucccggaucaaccacuucgagaagauccagaucauccccaagagcuccuggagcgaccacgaggccuccagcggcgucuccagcgugugcccguaccaggggacccccuccuucuuccgcaacguggucuggcugaucaagaagaacaacacguaccccaccaucaagaaguccuacaacaacaccaaccaggaggaccugcugauccucuggggcauccaccacagcaacgacgcggccgagcagaccaagcuguaccagaacccgacgaccuacaucagcguggggaccuccacccugaaccagcggcucgugcccaagaucgccacgcgcagcaaggucaacggccaguccgggcggauggacuucuucuggaccauccugaagcccaacgacgccaucaacuucgagagcaacggcaacuucaucgcgcccgaguacgccuacaagaucgugaagaagggcgacagcgccaucaugaaguccgagguggaguacgggaacugcaacaccaagugccagaccccgaucggcgccaucaacagcuccaugcccuuccacaacauccacccccugacgaucggggagugccccaaguacgucaagagcaacaagcucgugcuggccaccggccugcgcaacuccccgcuccgggagcgccggcgcaagcggggccuguucggggcgaucgccggcuucaucgagggcggguggcaggggaugguggacggcugguacggcuaccaccacagcaacgagcagggguccggcuacgccgccgacaaggagagcacccagaaggccaucgacggggucaccaacaaggugaacuccaucaucgacaagaugaacacgcaguucgaggcggugggccgcgaguucaacaaccuggagcggcgcaucgagaaccucaacaagaagauggaggacggguuccuggacgucuggaccuacaacgccgagcugcucgugcugauggagaacgagcggacccuggacuuccacgacagcaacgucaagaaccucuacgacaaggugcgccugcagcugcgggacaacgccaaggagcucggcaacggcugcuucgaguucuaccacaagugcgacaacgagugcauggaguccgugcgcaacgggaccuacgacuacccccaguacagcgaggaggcccggcugaagcgcgaggagaucuccggcgucaagcuggagagcaucgggacguaccagauccucuccaucuacagcaccguggccuccagccuggcgcuggccaucaugguggccggccucucccuguggaugugcagcaacgggagccugcagugccggaucugcaucuga

SEQ ID NO: 63495 - RNA, 1707 nt, Artificial Sequence
  derived and/or modified sequence opt1 from hemagglutinin__InfluenzaA__ACJ68614
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgucaacgaccugugcuaccccgggaacuucaacgacuacgaggagcucaagcaccuccugucccggaucaaccacuucgagaagauccagaucauccccaagagcuccuggagcgaccacgaggccuccagcggcguguccagcgccugcccguaccagggccgcuccagcuucuuccggaacguggucuggcugaucaagaagaacaacaccuaccccacgaucaagcgcuccuacaacaacaccaaccaggaggaccugcuggugcucugggggauccaccaccccaacgacgccgcggagcagacccggcuguaccagaacccgaccacguacaucagcgugggcaccuccacccugaaccagcgccucguccccaagcuggccacccggagcaaggugaacgggcaguccggccgcauggaguucuucuggacgauccugaagcccaacgacgccaucaacuucgagagcaacgggaacuucaucgcccccgagaacgcguacaagaucgugaagaagggcgacagcaccaucaugaaguccgagcucgaguacggcaacugcaacaccaagugccagaccccgaucggggccaucaacagcuccaugcccuuccacaacauccacccccugacgaucggcgagugccccaaguacgucaagagcaaccggcuggugcucgccaccgggcugcgcaacuccccgcagggcgagcggcgccggaagaagcgcggccuguucggggccaucgccggcuucaucgagggcggguggcaggggaugguggacggcugguacggcuaccaccacagcaacgagcggggguccggcuacgcggccgacaaggagagcacccagaaggccaucgacggggucaccaacaaggugaacuccaucaucgacaagaugaacacgcaguucgaggccgugggccgcgaguucaacaaccucgagcggcgcaucgagaaccugaacaagaagauggaggacggguuccuggacgucuggaccuacaacgccgagcuccuggugcugauggagaacgagcggacccucgacuuccacgacagcaacgucaagaaccuguacgacaaggugcgccugcagcuccgggacaacgcgaaggagcugggcaacggcugcuucgaguucuaccaccgcugcgacaacgagugcauggaguccgugcgcaacgggaccuacgacuacccccaguacagcgaggaggcccggcugaagcgcgaggagaucuccggcgucaagcucgagagcaucgggacguaccagauccuguccaucuacagcaccguggccuccagccuggcccucgccaucaugguggcgggccugucccuguggaugugcagcaacgggagccuccagugccggaucugcaucuga

SEQ ID NO: 63496 - RNA, 1698 nt, Artificial Sequence
  derived and/or modified sequence opt1 from hemagglutinin__InfluenzaA__ACK99007
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 63497 - RNA, 1698 nt, Artificial Sequence
  derived and/or modified sequence opt1 from hemagglutinin__InfluenzaA__ACK99008
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccauggaggucuaccagauccuggccaucuacagcaccguggccagcucccuggugcuccuggucagccugggcgccaucuccuucuggaugugcagcaacgggucccuccagugccggaucugcaucuga

SEQ ID NO: 63498 - RNA, 1698 nt, Artificial Sequence
  derived and/or modified sequence opt1 from hemagglutinin__InfluenzaA__ACK99009
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaccuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 63499 - RNA, 1698 nt, Artificial Sequence; identical to SEQ ID NO: 63496
  derived and/or modified sequence opt1 from hemagglutinin__InfluenzaA__ACK99011

SEQ ID NO: 63500 - RNA, 1698 nt, Artificial Sequence
  derived and/or modified sequence opt1 from hemagglutinin__InfluenzaA__ACK99012
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccugaucagccugggggccaucuccuucuggaugugcagcaacggcucccuccagugccggaucugcaucuga

SEQ ID NO: 63501 - RNA, 1698 nt, Artificial Sequence; identical to SEQ ID NO: 63496
  derived and/or modified sequence opt1 from hemagglutinin__InfluenzaA__ACK99013

SEQ ID NO: 63502 - RNA, 1698 nt, Artificial Sequence
  derived and/or modified sequence opt1 from hemagglutinin__InfluenzaA__ACK99014
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucacccucucccgcggguucggcagcggcaucaucaacuccaacgcccccauggacaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacagcaccguggccagcucccuggugcuccuggucagccugggggccaucuccuucuggaugugcagcaacggcucccuccagugccggaucugcaucuga

SEQ ID NO: 63503 - RNA, 1698 nt, Artificial Sequence; identical to SEQ ID NO: 63496
  derived and/or modified sequence opt1 from hemagglutinin__InfluenzaA__ACK99016

SEQ ID NO: 63504 - RNA, 1698 nt, Artificial Sequence; identical to SEQ ID NO: 63496
  derived and/or modified sequence opt1 from hemagglutinin__InfluenzaA__ACK99018

SEQ ID NO: 63505 - RNA, 1698 nt, Artificial Sequence; identical to SEQ ID NO: 63496
  derived and/or modified sequence opt1 from hemagglutinin__InfluenzaA__ACK99023

SEQ ID NO: 63506 - RNA, 1698 nt, Artificial Sequence
  derived and/or modified sequence opt1 from hemagglutinin__InfluenzaA__ACK99026
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccgaucaccaucggcgagugccccaaguacgugcggagcgccaagcugcgcauggugaccgggcuccggaacauccccuccauccagagccgcggccuguucggggccaucgccggcuucaucgagggcggguggaccggcauggucgacgggugguacggcuaccaccaccagaacgagcagggguccggcuacgcggccgaccagaaguccacccagaacgccaucaacggcaucacgaacaaggugaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcugguccuccuggagaacgagcggacgcuggacuuccacgacagcaacgugaagaaccucuacgagaaggugaagucccagcugaagaacaacgcgaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccaugggcguguaccagauccuggccaucuacagcaccgucgccagcucccuggugcuccuggugagccugggggccaucuccuucuggaugugcagcaacggcucccuccagugccggaucugcaucuga

SEQ ID NO: 63507 - RNA, 1698 nt, Artificial Sequence; identical to SEQ ID NO: 63180
  derived and/or modified sequence opt1 from hemagglutinin__InfluenzaA__ACK99027

SEQ ID NO: 63508 - RNA, 1698 nt, Artificial Sequence
  derived and/or modified sequence opt1 from hemagglutinin__InfluenzaA__ACK99028
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacccccaagggggccaucaacagcucccugcccuuccagaacguccacccggugacgaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 63509 - RNA, 1698 nt, Artificial Sequence
  derived and/or modified sequence opt1 from hemagglutinin__InfluenzaA__ACK99029
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucuccaagcgccccaaggugcgggaccaggagggccgcaucaacuacuacuggacccuccuggagcccggggacaccaucaucuucgaggccaacggcaaccugaucgcgccgcgguacgccuucgcccucagccgcggguucggcuccggcaucaucaacagcaacgcccccauggacaagugcgacgccaagugccagacgccccagggggcgaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgccgcggaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagagccagcugaagaacaacgccaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggcgaucuacagcaccguggccuccagccuggugcuccuggucucccugggggccaucagcuucuggaugugcuccaacggcagccuccagugccggaucugcaucuga

SEQ ID NO: 63510 - RNA, 1698 nt, Artificial Sequence; identical to SEQ ID NO: 63496
  derived and/or modified sequence opt1 from hemagglutinin__InfluenzaA__ACK99030

SEQ ID NO: 63511 - RNA, 1698 nt, Artificial Sequence; identical to SEQ ID NO: 63496
  derived and/or modified sequence opt1 from hemagglutinin__InfluenzaA__ACK99031

SEQ ID NO: 63512 - RNA, 1698 nt, Artificial Sequence; identical to SEQ ID NO: 63496
  derived and/or modified sequence opt1 from hemagglutinin__InfluenzaA__ACK99032

SEQ ID NO: 63513 - RNA, 1698 nt, Artificial Sequence; identical to SEQ ID NO: 63496
  derived and/or modified sequence opt1 from hemagglutinin__InfluenzaA__ACK99033

SEQ ID NO: 63514 - RNA, 1698 nt, Artificial Sequence
  derived and/or modified sequence opt1 from hemagglutinin__InfluenzaA__ACK99034
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcgacuucgggagcggcaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggguucaucgagggcggcuggaccgggaugguggacggcugguacggguaccaccaccagaacgagcagggcuccggguacgcggccgaccagaaguccacccagaacgccaucaacggcaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggccaucuacagcaccguggccagcucccuggugcuccuggucagccugggcgccaucuccuucuggaugugcagcaacgggucccuccagugccggaucugcaucuga

SEQ ID NO: 63515 - RNA, 1698 nt, Artificial Sequence
  derived and/or modified sequence opt1 from hemagglutinin__InfluenzaA__ACK99035
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccgccuucgagcgguucgagaucuucccgaaggagagcuccuggcccaaccacacggucaccggggugagcgccuccugcagccacaacggcgaguccagcuucuaccgcaaccugcuguggcucaccgggaagaacggccuguaccccaaccuguccaagagcuacgccaacaacaaggagaaggaggugcucguccuguggggcgugcaccacccgcccaacaucggcgaccagaaggcccuguaccacaccgagaacgccuacguguccgucgugagcagccacuacucccggaaguucacgcccgagaucagcaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacacccccauggacaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacagcaccguggccagcucccuggugcuccuggucagccugggggccaucuccuucuggaugugcagcaacggcucccuccagugccggaucugcaucuga

SEQ ID NO: 63516 - RNA, 1701 nt, Artificial Sequence; identical to SEQ ID NO: 63346
  derived and/or modified sequence opt1 from hemagglutinin__InfluenzaA__ACK99421

SEQ ID NO: 63517 - RNA, 1689 nt, Artificial Sequence
  derived and/or modified sequence opt1 from hemagglutinin__InfluenzaA__ACK99432
auggccaucaucuaccugauccuccuguucaccgccgugcgcggcgaccagaucugcaucggguaccacgcgaacaacagcaccgagaagaucgacacgauccuggagcggaacgucaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcgggugcccgaguggagcuacaucauggagaaggagaacccccgcuacucccucugcuacccgggcagcuucaacgacuacgaggagcugaagcaccuccuguccagcgucaagcacuucgagaaggugaagauccugcccaaggaccgguggacgcagcacaccaccaccgggggcuccauggccugcgccgugagcgggaagcccuccuucuuccgcaacauggucuggcugacgaccaagggccccaacuacccgguggcgcaggggagcuacaacaacaccuccggcgagcagaugcucaucaucuggggcgugcaccaccccaacgacgaggccgagcagcgggcccuguaccagaaggucgggaccuacgugagcgccuccacgagcacccuguacaagcgcuccauccccgagaucgcggcccggcccaaggugaacggccucgggagccgcauggaguucuccuggacccugcuggacaugugggacaccaucaacuucgagagcacgggcaaccucgucgccccggaguacggcuucaagaucuccaagcgggggagcagcggcaucaugaagaccgaggggacccuggagaacugcgagaccaagugccagacgccccugggcgccaucaacaccacccuccccuuccacaacgugcacccccugaccaucggggagugcccgaaguacgugaaguccgagaagcugguccucgccacgggccugcgcaacgugccccagaucgagagccggggccuguucggggcgaucgccggcuucaucgagggcggguggcaggggaugguggacggcugguacggcuaccaccacuccaacgaccaggggagcggcuacgccgccgacaaggaguccacccagaaggccuucgacgggaucaccaacaaggucaacagcgugaucgagaagaugaacacccaguucgaggcggugggcaaggaguucuccaaccucgagaagcgccuggagaaccugaacaagaagauggaggacggguuccucgacgucuggacguacaacgccgagcugcuggugcucauggagaacgagcggacccuggacuuccacgacagcaacgugaagaaccuguacgacaagguccgcaugcagcuccgggacaacgugaaggagcugggcaacggcugcuucgaguucuaccacaagugcgacaacgagugcauggacuccgucaagaacgggaccuacgacuaccccaaguacgaggaggagagcaagcugaaccgcaacgagaucaagggcgugaagcucuccagcauggggguguaccagauccuggccaucuacgccaccgucgccggcucccugagccucgcgaucaugauggccggcaucuccuucuggaugugcagcaacgggucccugcagugccggaucugcaucuga

SEQ ID NO: 63518 - RNA, 1701 nt, Artificial Sequence
  derived and/or modified sequence opt1 from hemagglutinin__InfluenzaA__ACK99443
augaaggccaagcugcucgugcugcugugcgccuucaccgcgaccgacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaaggagagcugguccuacaucgccgagacccccaacagcgagaacgggaccugcuaccccggcuacuucgccgacuacgaggagcuccgggagcagcuguccagcguguccagcuucgagcgcuucgagaucuuccccaaggaguccagcuggccgaaccacacggucaccaagggcgugaccgccgccugcucccacaacggcaagagcuccuucuaccggaaccugcucuggcugaccgagaagaacgggcuguaccccaaccucagcaaguccuacgugaacaacaaggagaaggagguccuggugcuguggggcgugcaccaccccagcaacaucggggaccagcgcgcgaucuaccacacggagaacgccuacgucagcgugguguccagccacuacucccggcgcuucacccccgagaucgccaagcggccgaagguccgcggccaggagggccggaucaacuacuacuggacccuccuggagcccggggacaccaucaucuucgaggccaacggcaaccugaucgcccccugguacgcguucgcccucagccgcggguucggcuccggcaucaucacgagcaacgccuccauggacgagugcgacgccaagugccagacgccccagggggccaucaacagcucccugccguuccagaacgugcaccccgugaccaucggcgagugccccaaguacguccggagcaccaagcugcgcauggugaccgggcuccggaacauccccuccgugcagagccgcggccuguucggggcgaucgccggcuucaucgagggcggguggaccggcaugaucgacgggugguacggcuaccaccaccagaacgagcagggguccggcuacgccgccgaccagaaguccacccagaacgccaucaacggcaucaccaacaaggucaacagcgugaucgagaagaugaacacgcaguucaccgcgguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgucaagaaccuguacgagaaggugaagucccagcugaagaacaacgccaaggagaucgggaacggcugcuucgaguucuaccacaagugcaacaacgagugcauggagagcgugaagaacgggacguacgacuacccgaaguacuccgaggagagcaagcucaaccgcgagaagaucgacggcgucaagcuggagagcaugggcguguaccagauccuggccaucuacuccaccguggccagcucccucguccugcuggugagccucggggcgaucuccuucuggaugugcagcaacggcucccugcagugccggaucugcaucuga

SEQ ID NO: 63519 - RNA, 1701 nt, Artificial Sequence
  derived and/or modified sequence opt1 from hemagglutinin__InfluenzaA__ACK99465
augaaggccaagcugcucgugcugcugugcgccuucaccgcgaccuacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaccgcgccccugcagcucgggaacugcuccguggccggcuggauccuggggaacccggagugcgagagccuguucuccaaggagagcugguccuacaucgccgagaagcccaaccccgagaacgggaccugcuaccccggcuacuucgccgacuacgaggagcuccgggagcagcugagcuccgucagcuccuucgagcgcuucgagaucuucccgaaggagagcuccuggcccaaccacacggugaccaagggcgugaccgccagcugcucccacaacggcaagagcuccuucuacaagaaccugcucuggcugaccaagaagaacgggcuguaccccaaccucagcaaguccuacgucaacaacaaggagaaggaggugcuggugcuguggggcguccaccaccccagcaacaucggggaccagcgggccaucuaccacacggagaacgcguacgugagcguggucuccagccacuacucccgccgguucaccccggagaucgccaagcgccccaaggugcgggaccaggagggccgcaucaacuacuacuggacccuccuggagcccggcgacaccaucaucuucgaggccaacgggaaccugaucgcccccugguacgccuucgcgcucagccggggcuucggguccggcaucaucacgagcaacgccuccaugggcgagugcgacgccaagugccagaccccgcagggggccaucaacagcucccugcccuuccagaacgugcaccccgucaccaucggcgagugccccaaguacgugcgcagcaccaagcugcggauggugacggggcuccgcaacaucccguccauccagagccggggccuguucggggccaucgcgggcuucaucgagggcggguggaccggcaugaucgacgggugguacggcuaccaccaccagaacgagcagggguccggcuacgccgccgacaagaaguccacccagaacgccaucgacggcaucaccaacaaggucaacagcgugaucgagaagaugaacacgcaguucaccgccguggggaaggaguucaacaagcuggagcgccggauggagaaccucaacaagaaggucgacgacggcuuccuggacaucuggaccuacaacgcggagcugcucgugcugcuggagaacgagcgcacccucgacuuccacgacagcaacgucaagaaccuguacgagaaggugaagaaccagcugaagaacaacgccaaggagaucgggaacggcugcuucgaguucuaccacaagugcaacaacgagugcauggaguccgugaagaacgggacguacgacuaccccaaguacagcgaggaguccaagcucaagcgggagaagaucgacggcgucaagcuggagagcaugggcguguaccagauccuggccaucuacagcaccguggccuccagccucguccugcuggugucccucggggccaucagcuucuggaugugcuccaacggcagccugcagugccgcaucugcaucuga

SEQ ID NO: 63520 - RNA, 1701 nt, Artificial Sequence
  derived and/or modified sequence opt1 from hemagglutinin__InfluenzaA__ACK99476
augaagaccaucaucgcccugagcuacauccucugcaugguguucgcccagaagcugcccggcaacgacaacuccaccgcgacgcugugccucgggcaccacgccgucccgaacggcacccuggugaagaccaucaccaacgaccagaucgaggugacgaacgccaccgagcugguccagagcuccagcaccgggcgcaucugcgacagcccccaccggauccucgacggcaagaacugcacccugaucgacgcccugcucggggacccccacugcgacgacuuccagaacaaggagugggaccuguucguggagcgcagcaaggccuacuccaacugcuaccccuacgacgugccggacuacgcgagccugcggucccucgucgccagcuccggcacgcuggaguucaacaacgagagcuucaacuggaccggcguggcccagaacgggaccuccuacgccugcaagcgccggagcgugaaguccuucuucagccgccugaacuggcuccacaagcuggaguacaaguaccccgcgcugaacgucaccaugcccaacaacgacaaguucgacaagcucuacaucuggggcgugcaccacccccggacggacuccgaccagaccagccuguacgugcaggccuccgggcgcgucaccgugagcaccaagcggagccagcagacggugaucccgaacaucggcuccagccccuggguccgcgggguguccagccggaucuccaucuacuggaccaucgugaagcccggcgacauccugcucaucaacagcaccggcaaccugaucgcgccccgcggguacuucaagauccgguccggcaagagcuccaucaugcgcagcgacgccccgaucgggaacugcaacuccgagugcaucacccccaacggcagcauccccaacgacaagcccuuccagaacgucaaccggaucacguacggcgccugcccgcgcuacgugaagcagaacacccugaagcucgccaccgggaugcggaacgugcccgagaagcagacccgcggcaucuucggggccaucgccggcuucaucgagaacgggugggagggcauggucgacggcugguacggguuccggcaccagaacuccgagggcacggggcaggccgccgaccugaaguccacccaggcggccaucaaccagaucaacggcaagcugaaccgccucaucgagaagaccaacgagaaguuccaccagaucgagaaggaguucuccgagguggaggggcggauccaggaccuggagaaguacguggaggacaccaagaucgaccuguggagcuacaacgccgagcuccuggucgcccuggagaaccagcacacgaucgaccucaccgacuccgagaugaacaagcuguucgagcgcacccgcaagcagcugcgggagaacgccgaggacaugggcaacggcugcuucaagaucuaccacaagugcgacaacgcgugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucagcugcuuccuccugugcguggugcugcucggguucaucaugugggccugccagaagggcaacauccggugcaacaucugcaucuga

SEQ ID NO: 63521 - RNA, 1698 nt, Artificial Sequence; identical to SEQ ID NO: 62922
  derived and/or modified sequence opt1 from hemagglutinin__InfluenzaA__ACL12063

SEQ ID NO: 63522 - RNA, 1701 nt, Artificial Sequence
  derived and/or modified sequence opt1 from hemagglutinin__InfluenzaA__ACL12129
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcggcagcccccaccggauccuggacgggaagaacugcacccugaucgacgcccuccugggcgacccccacugcgacggcuuccagaacaaggagugggaccuguucguggagcgcagcaaggccuacuccaacugcuaccccuacgacgugccggacuacgcgagccuccggucccuggucgccagcuccgggacgcuggaguucaucaacgaggacuucaacuggaccggcguggcccaggacgggggcagcuacgccugcaagcgcggguccgugaacagcuucuucucccggcucaacuggcugcacaagcuggaguacaaguaccccgcgcucaacgucaccaugcccaacaacggcaaguucgacaagcuguacaucuggggcgugcaccaccccagcaccgacuccgaccagacgagccuguacgugcgcgccuccgggcgggucaccgugagcaccaagcgcagccagcagaccgugacgccgaacaucggcucccggcccuggguccgcgggcagagcucccggaucagcaucuacuggaccaucgugaagcccggcgacauccuccugaucgacuccaccggcaaccugaucgcgccccgcggguacuucaagauccggaacggcaagagcuccaucaugcgcagcgacgccccgaucgggaacugcuccagcgagugcaucacccccaacggcuccauccccaacgacaagcccuuccagaacgugaaccggaucacguacggggccugcccgcgcuacgucaagcagaacacccucaagcuggccaccggcaugcggaacgugcccgagaagcagacccgcggcaucuucggggccaucgccggcuucaucgagaacgggugggagggcaugguggacgggugguacggcuuccggcaccagaacagcgagggcacggggcaggccgccgaccugaaguccacccaggcggccaucgaccagaucaacggcaagcucaaccgccugaucgagaagaccaacgagaaguuccagcagaucgagaaggaguucagcgaggucgaggggcggauccaggaccuggagaaguacguggaggacaccaagaucgaccucugguccuacaacgccgagcugcugguggcccucgagaaccagcacacgaucgaccugaccgacagcgagaugaacaagcuguucgagaagacccgcaagcagcuccgcgagaacgccgaggacaugggcaacgggugcuucaagaucuaccacaagugcgacaacgcgugcaucggcuccauccggaacggcaccuacgaccacgacgucuaccgcgacgaggcccugaacaaccgguuccagaucaaggggguggagcugaaguccggcuacaaggacuggauccucuggaucuccuucgccaucagcugcuuccugcugugcgucgugcuccugggguucaucaugugggccugccagaagggcaacauccgcugcaacaucugcaucuga

SEQ ID NO: 63523 - RNA, 1701 nt, Artificial Sequence; identical to SEQ ID NO: 63364
  derived and/or modified sequence opt1 from hemagglutinin__InfluenzaA__ACL12140

SEQ ID NO: 63524 - RNA, 1698 nt, Artificial Sequence; identical to SEQ ID NO: 63448
  derived and/or modified sequence opt1 from hemagglutinin__InfluenzaA__ACL12151

SEQ ID NO: 63525 - RNA, 1701 nt, Artificial Sequence; identical to SEQ ID NO: 63442
  derived and/or modified sequence opt1 from hemagglutinin__InfluenzaA__ACL12162

SEQ ID NO: 63526 - RNA, 1701 nt, Artificial Sequence
  derived and/or modified sequence opt1 from hemagglutinin__InfluenzaA__ACL12173
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucaaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 63527 - RNA, 1701 nt, Artificial Sequence
  derived and/or modified sequence opt1 from hemagglutinin__InfluenzaA__ACL12184
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacaaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 63528 - RNA, 1701 nt, Artificial Sequence; identical to SEQ ID NO: 63442
  derived and/or modified sequence opt1 from hemagglutinin__InfluenzaA__ACL12195

SEQ ID NO: 63529 - RNA, 1701 nt, Artificial Sequence
  derived and/or modified sequence opt1 from hemagglutinin__InfluenzaA__ACL12217
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacgugcugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 63530 - RNA, 1701 nt, Artificial Sequence; identical to SEQ ID NO: 63442
  derived and/or modified sequence opt1 from hemagglutinin__InfluenzaA__ACL12228

SEQ ID NO: 63531 - RNA, 1701 nt, Artificial Sequence; identical to SEQ ID NO: 63442
  derived and/or modified sequence opt1 from hemagglutinin__InfluenzaA__ACL12239

SEQ ID NO: 63532 - RNA, 1701 nt, Artificial Sequence
  derived and/or modified sequence opt1 from hemagglutinin__InfluenzaA__ACL12250
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcagcaaggccuacuccaacugcuaccccuacgacgugccggacuacgucagccugcggucccugguggcgagcuccggcacgcucgaguucaacaacgagagcuucaacuggaccggggugacccagaacggcaccuccagcgccugcauccgccgguccaacaacagcuucuucucccgccugaacuggcugacgcacagcaaguucaaguaccccgcccucaacgucaccaugcccaacaacgagaacuucgacaagcuguacaucuggggcgugcaccaccccgggaccgacaacgaccagaucuuccuguacgcccaggcguccgggcggaucaccgugagcacgaagcgcagccagcagaccgucaucccgaacaucggcucccggccccgcgugcggaacauccccagccgcaucuccaucuacuggaccaucgugaagcccggcgacauccuccugaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgucaaccgcaucaccuacggggccugcccccgguacgugaagcagaacacccucaagcuggccaccggcaugcgcaacgugcccgagaagcagacgcgggggaucuucggcgcgaucgccggguucaucgagaacggcugggagggcauggucgacgggugguacggcuuccgccaccagaacuccgaggggaucggccaggccgccgaccucaagagcacccaggccgcgaucgaccagaucaacgggaagcugaaccggcugaucggcaagaccaacgagaaguuccaccagaucgagaaggaguucuccgagguggagggccgcauccaggaccuggagaaguacguggaggacaccaagaucgaccucuggagcuacaacgccgagcugcuggucgcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgccugcaucgggagcauccgcaacggcaccuacgaccacgacguguaccgcgacgaggcgcugaacaaccgguuccagaucaaggggguggagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 63533 - RNA, 1701 nt, Artificial Sequence
  derived and/or modified sequence opt1 from hemagglutinin__InfluenzaA__ACL12261
augaaggccaagcugcucgugcugcugugcgccuucaccgcgaccgacgccgacacgaucugcaucggcuaccacgccaacaacagcaccgacaccgucgacaccgugcucgagaagaacgugacggucacccacuccgugaaccugcuggaggacagccacaacgggaagcucugccgccugaagggcaucgcgccccugcagcucgggaacugcuccaucgccggcuggauccuggggaacccggagugcgagagccuguucuccaagaaguccuggagcuacaucgccgagacccccaacagcgagaacgggaccugcuaccccggcuacuucgccgacuacgaggagcuccgggagcagcuguccagcguguccagcuucgagcgcuucgagaucuuccccaaggaguccagcuggccgaaccacacggucaccaagggcgugaccgccgccugcucccacaagggccggagcuccuucuaccgcaaccugcucuggcugaccgagaagaacgggcuguaccccaaccucagcaaguccuacgugaacaacaaggagaaggagguccuggugcuguggggcgugcaccaccccagcaacaucggggaccagcgggcgaucuaccacacggagaacgccuacgucagcgugguguccagccacuacaaccgccgguucacccccgagaucgccaagcgcccgaagguccggggccaggagggccgcaucaacuacuacuggacccuccuggagcccggggacaccaucaucuucgaggccaacggcaaccugaucgcccccugguacgcguucgcccucucccggggguucggcagcggcaucaucacguccaacgccagcauggacgagugcgacgccaagugccagacgccccagggggccaucaacuccagccugccguuccagaacgugcaccccgugaccaucggcgagugccccaaguacguccgcuccaccaagcugcggauggugaccgggcuccgcaacauccccagcauccagucccggggccuguucggggcgaucgccggcuucaucgagggcggguggaccggcaugaucgacgggugguacggcuaccaccaccagaacgagcaggggagcggcuacgccgccgaccagaaguccacccagaacgccaucaacggcaucaccaacaaggugaacagcgucaucgagaagaugaacacgcaguucaccgcgguggggaaggaguucaacaagcuggagaagcgcauggagaaccucaacaagaagguggacgacggcuuccuggacaucuggaccuacaacgccgagcugcucguccugcuggagaacgagcggacccucgacuuccacgacuccaacgugaagaaccuguacgagaaggucaagaaccagcugaagaacaacgccaaggagaucgggaacggcugcuucgaguucuaccacaagugcaacaacgagugcauggagagcgugaagaacgggacguacgacuacccgaaguacuccgaggagagcaagcucaaccgcgagaagaucgacggcgugaagcuggaguccaugggcgucuaccagauccuggccaucuacagcaccguggccagcucccucgugcugcuggucagccucggggcgaucuccuucuggaugugcagcaacggcucccugcagugccggaucugcaucuga

SEQ ID NO: 63534 - RNA, 1689 nt, Artificial Sequence
  derived and/or modified sequence opt1 from hemagglutinin__InfluenzaA__ACN32272
auggccaucaucuaccugauccuccuguucaccgccgugcgcggcgaccagaucugcaucggguaccacgcgaacaacagcaccgagaagaucgacacgauccuggagcggaacgucaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcgggugcccgaguggagcuacaucauggagaaggagaacccccgcuacucccucugcuacccgggcagcuucaacgacuacgaggagcugaagcaccuccuguccagcgucaagcacuucgagaaggugaagauccugcccaaggaccgguggacgcagcacaccaccaccgggggcuccauggccugcgccgugagcgggaagcccuccuucuuccgcaacauggucuggcugacgaccaagggccccaacuacccgguggcgcaggggagcuacaacaacaccuccggcgagcagaugcucaucaucuggggcgugcaccaccccaacgacgaggccgagcagcgggcccuguaccagaacgucgggaccuacgugagcgccuccacgagcacccuguacaagcgcuccauccccgagaucgcggcccggcccaaggugaacggccucgggagccgcauggaguucuccuggacccugcuggacaugugggacaccaucaacuucgagagcacgggcaaccucgucgccccggaguacggcuucaagaucuccaagcgggggagcagcggcaucaugaagaccgaggggacccuggagaacugcgagaccaagugccagacgccccugggcgccaucaacaccacccuccccuuccacaacgugcacccccugaccaucggggagugcccgaaguacgugaaguccgagaagcugguccucgccacgggccugcgcaacgugccccagaucgagagccggggccuguucggggcgaucgccggcuucaucgagggcggguggcaggggaugguggacggcugguacggcuaccaccacuccaacgaccaggggagcggcuacgccgccgacaaggaguccacccagaaggccuucgacgggaucaccaacaaggucaacagcgugaucgagaagaugaacacccaguucgaggcggugggcaaggaguucuccaaccucgagaagcgccuggagaaccugaacaagaagauggaggacggguuccucgacgucuggacguacaacgccgagcugcuggugcucauggagaacgagcggacccuggacuuccacgacagcaacgugaagaaccuguacgacaagguccgcaugcagcuccgggacaacgugaaggagcugggcaacggcugcuucgaguucuaccacaagugcgacaacgagugcauggacuccgucaagaacgggaccuacgacuaccccaaguacgaggaggagagcaagcugaaccgcaacgagaucaagggcgugaagcucuccagcauggggguguaccagauccuggccaucuacgccaccgucgccggcucccugagccucgcgaucaugauggccggcaucuccuucuggaugugcagcaacgggucccugcagugccggaucugcaucuga

SEQ ID NO: 63535 - RNA, 1701 nt, Artificial Sequence
  derived and/or modified sequence opt1 from hemagglutinin__InfluenzaA__ACN32283
augaagaccaucaucgcccugagcuacauccucugccugguguccgcccagaaguuccccggcaacgacaacagcaccgcgacgcugugccucgggcaccacgccgucccgaacggcaccaucgugaagaccaucaccaacgaccagaucgaggugacgaacgccaccgagcugguccaguccagcuccaccggggagaucugcgacagcccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucaacuggaccggggugacccagaacggcaccagcuccgccugcauccgccggagcaacaacuccuucuucagccgccugaacuggcugacgcaccucaaguucaaguaccccgcccugaacgugaccaugcccaacaacgaggaguucgacaagcuguacaucuggggcguccaccaccccgggaccgacaacgaccagaucuuccucuacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcugaucaacagcaccgggaaccucaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 63536 - RNA, 1701 nt, Artificial Sequence
  derived and/or modified sequence opt1 from hemagglutinin__InfluenzaA__ACN32474
augaagaccaucaucgcccugagcuacauccucugccugguguccgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcgacagcccccaccaggugcucgacggcgagaacugcacccugaucgacgcccugcucggggacccccagugcgacggcuuccagaacaagaagugggaccuguucguggagcgcuccaaggccuacagcaacugcuaccccuacgacgucccggacuacacgucccugcggagccucguggcguccagcggcacccuggaguucaacaacgaguccuucaacuggaccggggugacccagaacggcacgagcuccgccugcauccgccggagcaacaacuccuucuucagccgccugaacuggcucacccaccugaaguucaaguaccccgcccugaacaugaccaugcccaacaacgaggaguucgacaagcucuacaucuggggcguccaccaccccgggaccgacaacgaccagaucuuccuguacgcccaggcguccgggcggaucacggugagcaccaagcgcagccagcagaccgugaucccgaacaucggcucccggccccgcguccggaacauccccagccgcaucuccaucuacuggaccaucgugaagcccggcgacauccugcucaucaacagcacggggaaccugaucgccccgcggggcuacuucaagauccgcuccggcaagagcuccaucaugcggagcgacgcccccaucgggaagugcaacuccgagugcaucacccccaacggcagcauccccaacgacaagccguuccagaacgugaaccgcaucaccuacggggccugcccccgguacgucaagcagaacacccugaagcucgccacgggcaugcgcaacgugcccgagaagcagacccgggggaucuucggcgcgaucgccggguucaucgagaacggcugggagggcaugguggacgggugguacggcuuccgccaccagaacuccgaggggaucggccaggccgccgaccucaagagcacccaggccgcgaucgaccagaucaacgggaagcugaaccggcugaucggcaagaccaacgagaaguuccaccagaucgagaaggaguucuccgaggucgagggccgcauccaggaccuggagaaguacguggaggacacgaagaucgaccuguggagcuacaacgccgagcuccugguggcccuggagaaccagcacaccaucgaccucaccgacuccgagaugaacaagcuguucgagaagaccaagaagcagcugcgggagaacgccgaggacauggggaacggcugcuucaagaucuaccacaagugcgacaacgccugcaucgggagcauccgcaacggcacguacgaccacgaggucuaccgcgacgaggcgcucaacaaccgguuccagaucaaggggguggagcugaaguccggcuacaaggacuggauccuguggaucagcuucgccaucuccugcuuccuccugugcguggcccugcucggcuucaucaugugggccugccagaaggggaacauccgcugcaacaucugcaucuga

SEQ ID NO: 63537 - RNA, 1698 nt, Artificial Sequence; identical to SEQ ID NO: 63496
  derived and/or modified sequence opt1 from hemagglutinin__InfluenzaA__ACN32501

SEQ ID NO: 63538 - RNA, 1701 nt, Artificial Sequence
  derived and/or modified sequence opt1 from hemagglutinin__InfluenzaA__ACN32534
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccagauccuggacggcgagaacugcacccugaucgacgcccuccugggggacccccacugcgacggcuuccagaacaaggagugggaccuguucguggagcggagcaaggccuacuccaacugcuaccccuacgacgugccggacuacgucagccuccgcucccugguggcgagcuccggcacgcuggaguucaacaacgagagcuucaacuggaccgggguggcccagaacggcaccuccagcgccugcaagcggcgcuccgacaagagcuucuucucccggcucaacuggcugcaccagcugaaguacaaguaccccgcccucaacgucaccaugcccaacaacgagaaguucgacaagcuguacaucuggggcgugcaccaccccgggacggacagcgaccagaucucccuguacgcgcaggccagcgggcgcgugaccgucagcaccaagcggucccagcagaccgugaucccgaacaucggcagcggccccugggugcgcggggucuccagccggaucuccaucuacuggacgaucgugaagcccggcgacauccuccugaucaacagcaccgggaaccugaucgcgccccgcggcuacuucaagauccgguccggcaagagcuccaucaugcgcagcgacgccccgaucgggaagugcaacuccgagugcaucacccccaacggcagcauccccaacgggaagcccuuccagaacgugaaccggaucaccuacggcgccugcccgcgcuacgucaagcagaacacgcucaagcuggccaccgggaugcggaacgugcccgagaagcagacccgcggcaucuucggcgccaucgccggguucaucgagaacggcugggaggggaugauggacggcugguacggguuccggcaccagaacuccgagggcaccggccaggccgccgaccugaaguccacgcaggcggccaucaaccagaucaacgggaagcucaaccgccugaucgagaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacaccaucgaccugacggacuccgagaugaacaagcuguucgagcgcaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggcgucgagcugaaguccggguacaaggacuggauccucuggaucagcuucgccaucagcugcuuccugcugugcaucgugcuccugggcuucaucaugugggccugccagaaggggaacauccgcugcaacaucugcaucuga

SEQ ID NO: 63539 - RNA, 1701 nt, Artificial Sequence
  derived and/or modified sequence opt1 from hemagglutinin__InfluenzaA__ACN32545
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccacugcgacggcuuccagaacaagaagugggaccuguucguggagcgcagcaaggccuacuccaacugcuaccccuacgacgugccggacuacgcgagccugcggucccucaucgccagcuccggcacgcuggaguucaacaacgagagcuucaacuggaccggggucacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucuuccuguacgcgcaggccagcgggcggaucaccgucuccacgaagcgcagccagcagaccgugaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgugaagcagaacacccugaagcucgcgaccggcaugcgcaacguccccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 63540 - RNA, 1698 nt, Artificial Sequence
  derived and/or modified sequence opt1 from hemagglutinin__InfluenzaA__ACN32793
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgucaccgggguguccgccagcugcucccacaacggcaagagcuccuucuaccgcaaccugcuguggcucaccgggaagaacggccuguaccccaaccugagcgaguccuacgccaacaacaaggagaaggaggugcucguccuguggggcgugcaccacccgcccaacaucggggaccagcgggcccuguaccacacggagaacgccuacgugagcgucgugagcucccacuacagccgccgguucacccccgagaucgccaagcgccccaaggugcgggaccaggagggccgcaucaacuacuacuggacccuccuggagcccggggacaccaucaucuucgaggcgaacggcaaccugaucgccccgcgguucgccuucgcccucucccgcggguucggcagcggcaucaucacguccaacgcccccauggacgagugcgacgcgaagugccagacgccccagggggccaucaacagcucccugcccuuccagaacguccacccggugaccaucggcgagugccccaaguacgugcggagcaccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuuccuggacaucuggaccuacaacgccgagcugcucgugcugcuggagaacgagcggacccucgacuuccacgacagcaacgugaagaaccuguacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcucaaccgcgagaagaucgacggcgugaagcuggaguccaugggcgucuaccagauccuggcgaucuacagcaccguggccagcucccucgugcugcuggucagccucggggccaucuccuucuggaugugcagcaacggcucccugcagugccggaucugcaucuga

SEQ ID NO: 63541 - RNA, 1698 nt, Artificial Sequence; identical to SEQ ID NO: 62965
  derived and/or modified sequence opt1 from hemagglutinin__InfluenzaA__ACN32804

SEQ ID NO: 63542 - RNA, 1698 nt, Artificial Sequence; identical to SEQ ID NO: 62953
  derived and/or modified sequence opt1 from hemagglutinin__InfluenzaA__ACN32815

SEQ ID NO: 63543 - RNA, 1698 nt, Artificial Sequence; identical to SEQ ID NO: 62963
  derived and/or modified sequence opt1 from hemagglutinin__InfluenzaA__ACN32826

SEQ ID NO: 63544 - RNA, 1701 nt, Artificial Sequence; identical to SEQ ID NO: 63442
  derived and/or modified sequence opt1 from hemagglutinin__InfluenzaA__ACN32848

SEQ ID NO: 63545 - RNA, 1701 nt, Artificial Sequence
  derived and/or modified sequence opt1 from hemagglutinin__InfluenzaA__ACN32870
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcacagcaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccuccugaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 63546 - RNA, 1701 nt, Artificial Sequence; identical to SEQ ID NO: 63545
  derived and/or modified sequence opt1 from hemagglutinin__InfluenzaA__ACN32892

SEQ ID NO: 63547 - RNA, 1701 nt, Artificial Sequence; identical to SEQ ID NO: 63442
  derived and/or modified sequence opt1 from hemagglutinin__InfluenzaA__ACN32903

SEQ ID NO: 63548 - RNA, 1701 nt, Artificial Sequence
  derived and/or modified sequence opt1 from hemagglutinin__InfluenzaA__ACN32914
augaagaccaucaucgcccugagcuacauccucugccuggccuucgcgcagaagcugcccggcaacgacaacuccaccgccacgcucugccuggggcaccacgccgugccgaacggcaccaucgucaagaccaucaccaacgaccagaucgaggugacgaacgccaccgagcuggugcagagcuccagcaccggggagaucugcgacagcccccaccagauccucgacggcgagaacugcacccugaucgacgcccugcucggggacccccagugcgacggcuuccagaacaagaagugggaccuguucgucgagcgcagcaaggcguacuccaacugcuaccccuacgacgugccggacuacgccagccugcggucccucguggccagcuccggcacgcuggaguucaacaacgagagcuucaacuggaccggggucacccagaacggcaccuccagcgccugcauccgccgguccaacaacagcuucuucucccgccugaacuggcucacgcaccugaaguucaaguaccccgcgcugaacgugaccaugcccaacaacgagcaguucgacaagcucuacaucuggggcgugcaccaccccgggaccgacaacgaccagaucuuccuguacgcccaggccagcgggcggaucaccgucuccacgaagcgcagccagcagaccgugaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 63549 - RNA, 1701 nt, Artificial Sequence; identical to SEQ ID NO: 63442
  derived and/or modified sequence opt1 from hemagglutinin__InfluenzaA__ACN32925

SEQ ID NO: 63550 - RNA, 1701 nt, Artificial Sequence
  derived and/or modified sequence opt1 from hemagglutinin__InfluenzaA__ACN32936
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcacagcaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcagccagcagaccgugaucccgaacaucggcucccggccccgcaucaagaacauccccagccggaucuccaucuacuggaccaucgucaagcccggcgacauccuccugaucaacagcaccgggaaccugaucgccccgcgcggcuacuucaagauccgguccgggaaguccuccaucaugcgcagcgacgcccccaucggcaagugcaacuccgagugcaucacgcccaacggcagcauccccaacgacaagccguuccagaacgugaaccggaucaccuacggggccugcccccgcuacgugaagcagaacacccucaagcuggcgaccggcaugcggaacguccccgagaagcagacgcgcgggaucuucggcgccaucgccggguucaucgagaacggcugggagggcaugguggacgggugguacggcuuccggcaccagaacuccgaggggaucggccaggccgccgaccucaagagcacccaggcggccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccucuggagcuacaacgccgagcugcugguggcccucgagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccggaacggcaccuacgaccacgacguguaccgcgacgaggcccugaacaaccgcuuccagaucaagggggucgagcugaaguccggcuacaaggacuggauccucuggaucagcuucgccaucuccugcuuccugcugugcaucgcccuccugggcuucaucaugugggccugccagaaggggaacauccggugcaacaucugcaucuga

SEQ ID NO: 63551 - RNA, 1701 nt, Artificial Sequence; identical to SEQ ID NO: 63442
  derived and/or modified sequence opt1 from hemagglutinin__InfluenzaA__ACN32947

SEQ ID NO: 63552 - RNA, 1701 nt, Artificial Sequence
  derived and/or modified sequence opt1 from hemagglutinin__InfluenzaA__ACN32958
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcaacaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaacaacuccuucuucagccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 63553 - RNA, 1701 nt, Artificial Sequence
  derived and/or modified sequence opt1 from hemagglutinin__InfluenzaA__ACN32969
augaagaccaucaucgcccugagcuacauccucugccugguguccgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcgacagcccccaccaggugcucgacggcgagaacugcacccugaucgacgcccugcucggggacccccagugcgacggcuuccagaacaagaagugggaccuguucguggagcgcuccaaggccuacagcaacugcuaccccuacgacgucccggacuacgcgucccugcggagccucguggccuccagcggcacgcuggaguucaacaacgaguccuucaacuggaccggggugacccagaacggcaccagcuccgccugcauccgccggagcaacaacuccuucuucagccgccugaacuggcucacgcacuccaaguucaaguaccccgcccugaacgucaccaugcccaacaacgaggaguucgacaagcuguacaucuggggcgugcaccaccccgggaccgacaacgaccagaucuuccucuacgcgcaggccagcgggcggaucaccgugagcacgaagcgcucccagcagaccgucaucccgaacaucggcagccggccccgcgugcggaacauccccucccgcaucagcaucuacuggaccaucgugaagcccggcgacauccugcugaucaacuccaccgggaaccucaucgccccgcggggcuacuucaagcugcgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgagguguaccgcgacgaggcccucaacaaccgguuccagaucaaggggguggagcucaagagcggcuacaaggacuggauccuguggaucuccuucgccaucagcugcuuccugcugugcgucgcccugcucggcuucaucaugugggccugccagaaggggaacauccgcugcaacaucugcaucuga

SEQ ID NO: 63554 - RNA, 1701 nt, Artificial Sequence
  derived and/or modified sequence opt1 from hemagglutinin__InfluenzaA__ACN32980
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggcccacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaaguucaaguaccccgcccugaacgugaccaugcccaacgacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcgucggguccauccgcaacggcaccuacgaccacgacguguaccgcgacgaggcccucaacaaccgguuccagaucaaggggguggagcugaaguccggcuacaaggacuggauccuguggaucuccuucgccaucagcugcuuccuccugugcgucgcccugcucggcuucaucaugugggccugccagaaggggaacauccgcugcaacaucugcaucuga

SEQ ID NO: 63555 - RNA, 1701 nt, Artificial Sequence; identical to SEQ ID NO: 63442
  derived and/or modified sequence opt1 from hemagglutinin__InfluenzaA__ACN32991

SEQ ID NO: 63556 - RNA, 1701 nt, Artificial Sequence; identical to SEQ ID NO: 63442
  derived and/or modified sequence opt1 from hemagglutinin__InfluenzaA__ACN33002

SEQ ID NO: 63557 - RNA, 1701 nt, Artificial Sequence; identical to SEQ ID NO: 63442
  derived and/or modified sequence opt1 from hemagglutinin__InfluenzaA__ACN33013

SEQ ID NO: 63558 - RNA, 1701 nt, Artificial Sequence
  derived and/or modified sequence opt1 from hemagglutinin__InfluenzaA__ACN33035
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacgucuggggcgugcaccaccccgggaccgacaacgaccagaucuuccuguacgcgcaggccagcgggcggaucaccguguccacgaagcgcagccagcagaccgucaucccgaacaucggcagccggccccgcgugcggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcucgcgaccggcaugcgcaacgugcccgagaagcagacgcgggggaucuucggcgccaucgccggguucaucgagaacggcugggagggcauggucgacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaaggggguggagcugaaguccggcuacaaggacuggauccuguggaucuccuucgccaucagcugcuuccuccugugcgucgcccugcucggcuucaucaugugggccugccagaaggggaacauccggugcaacaucugcaucuga

SEQ ID NO: 63559 - RNA, 1701 nt, Artificial Sequence; identical to SEQ ID NO: 63442
  derived and/or modified sequence opt1 from hemagglutinin__InfluenzaA__ACN33046

SEQ ID NO: 63560 - RNA, 1701 nt, Artificial Sequence; identical to SEQ ID NO: 63442
  derived and/or modified sequence opt1 from hemagglutinin__InfluenzaA__ACN33057

SEQ ID NO: 63561 - RNA, 1701 nt, Artificial Sequence; identical to SEQ ID NO: 63442
  derived and/or modified sequence opt1 from hemagglutinin__InfluenzaA__ACN33068

SEQ ID NO: 63562 - RNA, 1701 nt, Artificial Sequence; identical to SEQ ID NO: 63545
  derived and/or modified sequence opt1 from hemagglutinin__InfluenzaA__ACN33079

SEQ ID NO: 63563 - RNA, 1698 nt, Artificial Sequence
  derived and/or modified sequence opt1 from hemagglutinin__InfluenzaA__ACN33090
augaaggugaagcugcucauccugcugugcaccuucaccgccacguacgccgacaccaucugcaucggcuaccacgcgaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccaccccagcaacaucggggaccagcgggcccuguaccacacggagaacgccuacgugagcguggucuccagccacuacucccgccgguucaccccggagaucgccaagcgccccaaggugcgggaccaggagggccgcaucaacuacuacuggacccuccuggagcccggggacaccaucaucuucgaggcgaacggcaaccugaucgcgccccgguucgccuucgcccucagccgcggguucggcuccggcaucaucacgagcaacgccccgauggacgagugcgacgccaagugccagacgccccagggggccaucaacuccagccugcccuuccagaacgugcaccccgucaccaucggcgagugcccgaaguacgugcgguccaccaagcugcgcauggugaccgggcuccggaacauccccagcauccagucccgcggccuguucggggccaucgccggcuucaucgagggcggguggaccggcauggucgacgggugguacggcuaccaccaccagaacgagcaggggagcggcuacgccgcggaccagaaguccacccagaacgccaucaacggcaucaccaacaaggugaacagcgugaucgagaagaugaacacgcaguucaccgccgucgggaaggaguucaacaagcuggagcggcgcauggagaaccucaacaagaagguggacgacggcuuccuggacaucuggaccuacaacgccgagcugcucguccugcuggagaacgagcggacccucgacuuccacgacuccaacgugaagaaccuguacgagaaggucaagagccagcugaagaacaacgccaaggagaucgggaacggcugcuucgaguucuaccacaagugcaacgacgagugcauggaguccgugaagaacgggacguacgacuaccccaaguacagcgaggaguccaagcucaaccgcgagaagaucgacggcgugaagcuggagagcaugggcguguaccagauccuggcgaucuacagcaccgucgccuccagccucgugcugcuggugucccucggggccaucagcuucuggaugugcuccaacggcagccugcagugccggaucugcaucuga

SEQ ID NO: 63564 - RNA, 1698 nt, Artificial Sequence; identical to SEQ ID NO: 62922
  derived and/or modified sequence opt1 from hemagglutinin__InfluenzaA__ACN33101

SEQ ID NO: 63565 - RNA, 1701 nt, Artificial Sequence; identical to SEQ ID NO: 63545
  derived and/or modified sequence opt1 from hemagglutinin__InfluenzaA__ACN33112

SEQ ID NO: 63566 - RNA, 1698 nt, Artificial Sequence; identical to SEQ ID NO: 63496
  derived and/or modified sequence opt1 from hemagglutinin__InfluenzaA__ACN33123

SEQ ID NO: 63567 - RNA, 1698 nt, Artificial Sequence; identical to SEQ ID NO: 63496
  derived and/or modified sequence opt1 from hemagglutinin__InfluenzaA__ACN33145

SEQ ID NO: 63568 - RNA, 1701 nt, Artificial Sequence; identical to SEQ ID NO: 63442
  derived and/or modified sequence opt1 from hemagglutinin__InfluenzaA__ACN33156

SEQ ID NO: 63569 - RNA, 1701 nt, Artificial Sequence
  derived and/or modified sequence opt1 from hemagglutinin__InfluenzaA__ACN33178
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcacagcaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccuccugaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccacaucaaggggguggagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 63570 - RNA, 1701 nt, Artificial Sequence; identical to SEQ ID NO: 63442
  derived and/or modified sequence opt1 from hemagglutinin__InfluenzaA__ACN33189

SEQ ID NO: 63571 - RNA, 1701 nt, Artificial Sequence
  derived and/or modified sequence opt1 from hemagglutinin__InfluenzaA__ACN33200
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcacagcaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucguggagcccggcgacauccuccugaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 63572 - RNA, 1701 nt, Artificial Sequence
  derived and/or modified sequence opt1 from hemagglutinin__InfluenzaA__ACN33211
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcuccaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucagcaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 63573 - RNA, 1698 nt, Artificial Sequence; identical to SEQ ID NO: 62964
  derived and/or modified sequence opt1 from hemagglutinin__InfluenzaA__ACN42981

SEQ ID NO: 63574 - RNA, 1698 nt, Artificial Sequence; identical to SEQ ID NO: 63198
  derived and/or modified sequence opt1 from hemagglutinin__InfluenzaA__ACN42992

SEQ ID NO: 63575 - RNA, 1701 nt, Artificial Sequence; identical to SEQ ID NO: 63442
  derived and/or modified sequence opt1 from hemagglutinin__InfluenzaA__ACN43003

SEQ ID NO: 63576 - RNA, 1701 nt, Artificial Sequence
  derived and/or modified sequence opt1 from hemagglutinin__InfluenzaA__ACN43014
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcagcaaggccuacuccaacugcuaccccuacgacgugccggacuacgcgagccugcggucccuggucgccagcuccggcacgcucgaguucaacaacgagagcuucaacuggaucggggugacccagaacggcaccuccagcgccugcauccgccgguccaacaacagcuucuucucccgccugaacuggcugacccacagcaaguucaaguaccccgcccucaacgugacgaugcccaacaacgagaacuucgacaagcuguacaucuggggcguccaccaccccgggaccgacaacgaccagaucuuccuguacgcgcaggccuccgggcggaucaccgugagcaccaagcgcagccagcagacggugaucccgaacaucggcucccggccccgcguccggaacauccccagccgcaucuccaucuacuggaccaucgugaagcccggcgacauccuccugaucaacagcaccgggaaccugaucgccccgcggggcuacuucaagauccgcuccgggaaguccuccaucaugcggagcgacgcccccaucggcaacugcaacuccgagugcaucacccccaacggcagcauccccaacgacaagccguuccagaacgugaaccgcaucacguacggguccugcccccgguacgucaagcagaacacccucaagcuggccaccggcaugcgcaacgugcccgagaagcagacccgggggaucuucggcgcgaucgccggguucaucgagaacggcugggagggcaugguggacgggugguacggcuuccgccaccagaacagcgaggggaucggccaggccgccgaccugaaguccacgcaggccgcgaucgaccagaucaacgggaagcucaaccggcugaucggcaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacaccaucgaccugacggacagcgagaugaacaagcuguucgagaagaccaagaagcagcuccgggagaacgccgaggacauggggaacggcugcuucaagaucuaccacaagugcgacaacgccugcaucggguccauccgcaacggcaccuacgaccacgacgucuaccgcgacgaggcgcugaacaaccgguuccagaucaaggggguggagcucaagagcggcuacaaggacuggauccuguggaucuccuucgccaucagcugcuuccugcugugcaucgcccuccugggcuucaucaugugggccugccagaaggggaacauccgcugcaacaucugcaucuga

SEQ ID NO: 63577 - RNA, 1701 nt, Artificial Sequence; identical to SEQ ID NO: 63442
  derived and/or modified sequence opt1 from hemagglutinin__InfluenzaA__ACN43025

SEQ ID NO: 63578 - RNA, 1701 nt, Artificial Sequence; identical to SEQ ID NO: 63442
  derived and/or modified sequence opt1 from hemagglutinin__InfluenzaA__ACN43036

SEQ ID NO: 63579 - RNA, 1701 nt, Artificial Sequence; identical to SEQ ID NO: 63442
  derived and/or modified sequence opt1 from hemagglutinin__InfluenzaA__ACN43047

SEQ ID NO: 63580 - RNA, 1701 nt, Artificial Sequence
  derived and/or modified sequence opt1 from hemagglutinin__InfluenzaA__ACN43058
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcggcagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggccgggggcaggccgccgaccugaaguccacccaggcggccaucgaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 63581 - RNA, 1701 nt, Artificial Sequence; identical to SEQ ID NO: 63442
  derived and/or modified sequence opt1 from hemagglutinin__InfluenzaA__ACN43069

SEQ ID NO: 63582 - RNA, 1701 nt, Artificial Sequence; identical to SEQ ID NO: 63545
  derived and/or modified sequence opt1 from hemagglutinin__InfluenzaA__ACN43080

SEQ ID NO: 63583 - RNA, 1701 nt, Artificial Sequence
  derived and/or modified sequence opt1 from hemagglutinin__InfluenzaA__ACN72617
auggaggccaagcuguucguccucuucugcgccuucaccgcgcugaaggccgacaccaucugcgugggcuaccacgccaacaacagcacggacaccguggacaccauccuggagaagaacgugaccgucacgcacuccgugaaccuccuggagaacagccacaacgggaagcugugcucccucaacggcaaggcgccccugcagcuggggaacugcaacguggccggcuggauccucgggaacccggagugcgaccugcugcucaccgccaacagcugguccuacaucaucgagaccagcgacuccaagaacggcgccugcuaccccggcgaguucgccgacuacgaggagcugcgcgagcagcugagcaccgucuccagcuucgagcgguucgagaucuuccccaaggccacguccuggcccaaccacgagaccaccaaggggaccacgguggcgugcagccacuccggcgccaacagcuucuaccgcaaccuccuguggaucgugaagaaggggaacuccuacccgaagcugagcaaguccuacaccaacaacaagggcaaggagguccucgugaucuggggcgugcaccacccgcccaccgacagcgaccagcagacccuguaccagaacaagcacacguacgucuccguggggagcagcaaguacuaccagcgguucacccccgagaucgugacccgccccaagguccgggagcaggccggccgcaugaacuacuacuggacccugcucgaccagggggacacgaucaccuucgaggccaccggcaaccugaucgcccccuggcacgcguucgcccugaacaagggguccaacagcggcaucaugauguccgacgcccacgugcacaacugcaccacgaagugccagacgccccacggcgcccucaaggggaaccugcccuuccagaacgugcacccgaucaccaucggcgagugccccaaguacgucaagagcacccagcugcggauggccaccgggcuccgcaacauccccuccauccagagccggggccuguucggggcgaucgccggcuucaucgagggcggguggaccggcaugaucgacgggugguacggcuaccaccaccagaacgagcagggguccggcuacgccgccgaccgcaagagcacccagaucgccaucgacggcaucuccaacaaggugaacagcgugaucgagaagaugaacauccaguucaccuccgucgggaaggaguucaacaaccuggagaagcggaucgagaaccucaacaagaagguggacgacggcuuccuggacguguggacguacaacgcggagcugcucauccugcuggagaacgagcgcacccucgacuuccacgacuucaacgucaagaaccuguacgagaaggucaagagccagcugcggaacaacgccaaggagaucgggaacggcugcuucgaguucuaccacaagugcgacaacgagugcauggaguccgugaagaacgggaccuacaacuacccccgcuacagcgaggaguccaagcucaaccgggaggagaucgacggcgugaagcuggagagcgugggcguccaccagauccuggccaucuacuccaccguggccagcucccucgugcugcuggucagccucggggccaucagcuucuggaugugcuccaacggcagccugcagugccgcaucugcaucuga

SEQ ID NO: 63584 - RNA, 1701 nt, Artificial Sequence
  derived and/or modified sequence opt1 from hemagglutinin__InfluenzaA__ACN72632
augaagaccgugaucgcccugagcuacgucuucugccucguguucggccaggaccugcccgggaagggcaacaacaccgccacgcugugccucgggcaccacgcggugccgaacggcacccuggucaagaccaucaccgacgaccagaucgaggugacgaacgccaccgagcuggugcagaacuucuccaucgggaagaucugcaagaacccccaccgcauccucgacggcgccaacugcacccugaucgacagccugcucggcgacccccacugcgacggguuccagaacgagaagugggaccuguucaucgagcgguccaaggccuucagcaacugcuaccccuacgacgucccggaguacaccucccugcgcagccucaucgccuccagcggcacgcuggaguucaccaacgaggacuucaacuggaccggggugacccagaacggcggguccagcgcgugcaagcggggccccaacaacuccuucuucagccgccugaacuggcucuacaaguccggcaacacguaccccaugcugaacgugaccaugcccaacagcgacgacuucgacaagcuguacaucuggggcguccaccacccguccaccgaccgggagcagaccaaccucuacauccaggccagcgggaagaucaucguguccacgaagcgcagccagcagaccaucauccccaacaucgggucccggcccugggugcgcggccugagcagccggaucuccaucuacuggaccaucgucaagcccggcgacauccugaucaucaacagcaacgggaaccucaucgccccgcgcggcuacuucaagauccagaccgggaaguccagcgugaugcgguccgacgcccccaucggcacgugcaacuacgagugcaucacccccaacgggagcauccccaacgacaagccguuccagaacgugaaccgcaucaccuacggcgcgugcccccacuacaucaagcagaacacccugaagcuggccacgggcaugcggaacauccccgagcgccagacccgggggaucuucggcgccaucgccggguucaucgagaacggcugggaggggauggucaacggcugguacggcuuccgccaccagaacuccgaggggaucggccaggccgcggaccucaagagcacccaggccgccaucaaccagaucaacgggaagcugaaccgggugaucgagaagaccaacgagaaguuccaccagaucgagaaggaguucuccgagguggagggccgcauccaggaccuggagcgguacgucgaggacacgaagaucgaccucuggagcuacaacgccgagcugcugguggcccucgagaaccagcacaccaucgaccugaccgacuccgagaugaacaagcuguucgagaagacccgcaagcagcuccgggagaacgcggaggacauggggaacggcugcuucaagaucuaccacaagugcgacaacagcugcauggaguccauccgcaacggcacguacgaccacaacgaguaccgcgacgaggccgugaacaaccgguuccagaucaagagcgucgagcugaaguccggguacaaggacuggauccuguggaucagcuucgccaucuccugcuuccuccugugcgccguguggcugggcuucaucaucugggccugccagaaggggaacauccgcugcaacaucugcaucuga

SEQ ID NO: 63585 - RNA, 1701 nt, Artificial Sequence; identical to SEQ ID NO: 63442
  derived and/or modified sequence opt1 from hemagglutinin__InfluenzaA__ACN76478

SEQ ID NO: 63586 - RNA, 1701 nt, Artificial Sequence
  derived and/or modified sequence opt1 from hemagglutinin__InfluenzaA__ACN76489
augaagaccaucaucgcccugggcuacauccucugccuggugagcgcccagaagcugcccgggaacgacaacuccaccgcgacgcucugccugggccaccacgccgucccgaacgggaccaucgugaagaccaucaccaacgaccagaucgaggugacgaacgccaccgagcugguccagagcuccagcaccggcgagaucugcgacagcccccaccaggugcucgacggggagaacugcacccugaucgacgcccugcucggcgacccccagugcgacggcuuccagaacaagaagugggaccuguucguggagcgcagcaaggccuacuccaacugcuaccccuacgacgucccggacuacgcgagccugcggucccucguggccagcuccgggacgcuggaguucaacaacgagagcuucaacuggaccggcgugacccagaacgggaccuccagcgccugcauccgccgguccaacaacagcuucuucucccgccugaacuggcucacgcaccugaaguucaaguaccccgcccugaacgucaccaugcccaacaacgaggaguucgacaagcucuacaucuggggcgugcaccaccccgggaccgacaacgaccagaucuuccuguacgcgcaggccagcggccggaucaccguguccacgaagcgcagccagcagaccgucaucccgaacaucggcagccggccccgcgugcggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacacgaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgagguguaccgcgacgaggcccucaacaaccgguuccagaucaagggcguggagcugaaguccggcuacaaggacuggauccuguggaucuccuucgccaucagcugcuuccuccugugcgucgcccugcucggguucaucaugugggccugccagaagggcaacauccgcugcaacaucugcaucuga

SEQ ID NO: 63587 - RNA, 1701 nt, Artificial Sequence; identical to SEQ ID NO: 63442
  derived and/or modified sequence opt1 from hemagglutinin__InfluenzaA__ACN76500

SEQ ID NO: 63588 - RNA, 1701 nt, Artificial Sequence; identical to SEQ ID NO: 63442
  derived and/or modified sequence opt1 from hemagglutinin__InfluenzaA__ACN76511

SEQ ID NO: 63589 - RNA, 1701 nt, Artificial Sequence; identical to SEQ ID NO: 63442
  derived and/or modified sequence opt1 from hemagglutinin__InfluenzaA__ACN76522

SEQ ID NO: 63590 - RNA, 1701 nt, Artificial Sequence; identical to SEQ ID NO: 63442
  derived and/or modified sequence opt1 from hemagglutinin__InfluenzaA__ACO36331

SEQ ID NO: 63591 - RNA, 1701 nt, Artificial Sequence
  derived and/or modified sequence opt1 from hemagglutinin__InfluenzaA__ACO36342
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcacagcaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccuccugaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgagaucgagggccgcauccaggaccuggagaaguacgucgaggacaccaagaucgaccucuggagcuacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 63592 - RNA, 1701 nt, Artificial Sequence
  derived and/or modified sequence opt1 from hemagglutinin__InfluenzaA__ACO36364
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggaccggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 63593 - RNA, 1701 nt, Artificial Sequence; identical to SEQ ID NO: 63309
  derived and/or modified sequence opt1 from hemagglutinin__InfluenzaA__ACO36375

SEQ ID NO: 63594 - RNA, 1698 nt, Artificial Sequence; identical to SEQ ID NO: 63496
  derived and/or modified sequence opt1 from hemagglutinin__InfluenzaA__ACO36397

SEQ ID NO: 63595 - RNA, 1701 nt, Artificial Sequence; identical to SEQ ID NO: 63309
  derived and/or modified sequence opt1 from hemagglutinin__InfluenzaA__ACO36408

SEQ ID NO: 63596 - RNA, 1701 nt, Artificial Sequence; identical to SEQ ID NO: 62936
  derived and/or modified sequence opt1 from hemagglutinin__InfluenzaA__ACO36419

SEQ ID NO: 63597 - RNA, 1701 nt, Artificial Sequence; identical to SEQ ID NO: 62936
  derived and/or modified sequence opt1 from hemagglutinin__InfluenzaA__ACO36430

SEQ ID NO: 63598 - RNA, 1701 nt, Artificial Sequence
  derived and/or modified sequence opt1 from hemagglutinin__InfluenzaA__ACO36441
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcgccugcaagcgccgguccaacaagagcuucuucucccgccugaacuggcucacgcaccugaaguacaaguaccccgcccugaacgugaccaugcccaacaacgagaaguucgacaagcucuacaucuggggcguccaccaccccgggaccgacagcgaccagaucucccuguacgcgcaggccagcggccggaucaccgugagcacgaagcgcucccagcagaccgugaucccgaacaucggcagccggccccgcguccgggacguguccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcaacuccgagugcaucacgcccaacgggagcauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucagcugcuuccuccugugcgucgcccugcucggguucaucaugugggccugccagaagggcaacauccggugcgacaucugcaucuga

SEQ ID NO: 63599 - RNA, 1701 nt, Artificial Sequence
  derived and/or modified sequence opt1 from hemagglutinin__InfluenzaA__ACO36452
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcuccugcaagcgccggagcaacaacuccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcccaggcgagcggccggaucaccaucuccacgaagcgcagccagcagaccgugaucccgaacaucggcucccggccccgcgugcgggacgucagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagaagcagacgcggggcaucuucggggccaucgccggcuucaucgagaacggcugggaggggaugguggacggcugguacggguuccgccaccagaacagcgagggcaccgggcaggccgccgaccugaaguccacccaggccgcgaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgccugcaucggcuccauccgcaacgggacguacgaccacgacgucuaccgggacgaggcgcucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 63600 - RNA, 1701 nt, Artificial Sequence
  derived and/or modified sequence opt1 from hemagglutinin__InfluenzaA__ACO36463
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucaucgagcgcagcaaggccuacuccaacugcuaccccuacgacgugccggacuacgcgagccugcggucccucguggccagcuccgggacgcuggaguucaacaacgagagcuucaacuggaccggcgucacccagaacgggaccuccagcgccugccagcgccgguccaacaagagcuucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucagccuguacgcgcagaccuccggccggaucacggucagcaccaagcgcagccagcagaccgugaucccgaacaucggcucccggccccgcgugcgggacguccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgugaaccgcaucaccuacggcgccugcccccgguacgucaagcagaacacccugaagcucgccacggggaugcgcaacgugcccgagcggcagacccgcggcaucuucggggcgaucgccggcuucaucgagaacggcugggaggggaugguggacggcugguacggguuccggcaccagaacuccgagggcaccgggcaggccgccgaccugaaguccacccaggccgcgaucaaccagaucaacggcaagcugaaccgccucaucggcaagacgaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacaccaucgaccucaccgacuccgagaugaacaagcuguucgagcgcacgaagaagcagcugcgcgagaacgccgaggacaugggcaacgggugcuucaagaucuaccacaagugcgacaacgccugcaucggcagcauccggaacgggaccuacgaccacgacgucuaccgcgacgaggcgcucaacaaccgguuccagaucaagggcguggagcugaaguccggcuacaaggacuggauccuguggaucagcuucgccaucuccugcuucgugcucugcgucgcccugcugggguucaucaugugggccugccagaagggcaacauccgcugcaacaucugcaucuga

SEQ ID NO: 63601 - RNA, 1701 nt, Artificial Sequence
  derived and/or modified sequence opt1 from hemagglutinin__InfluenzaA__ACO36474
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcuccugcaagcgccggagcaacaacuccuucuucagccgccugaacuggcucacgcaccuccgguacaaguaccccgcccugaacgugaccaugcccaacaacgagaaguucgacaagcuguacaucuggggcguccaccaccccgggaccgacuccgaccagaucagccuguacgcccaggcgagcggccgcaucaccguguccacgaagcggagccagcagaccgugaucccgaacaucggcucccgcccccggguccgcgacgugagcucccggaucagcaucuacuggaccaucgugaagcccggggacauccugcucaucaacuccaccggcaaccugaucgcgccccgcggguacuucaagauccggagcggcaaguccagcaucaugcgcuccgacgccccgaucggcaagugcaacagcgagugcaucacgcccaacggguccauccccaacgacaagcccuuccagaacgucaaccggaucaccuacggcgacugcccgcgcuacgugaagcagaacacccugaagcucgccaccgggaugcggaacgugcccgagaagcagacgcgcggcaucuucggggccaucgccggcuucaucgagaacggcugggaggggauggucgacggcugguacggguuccggcaccagaacagcgagggcaccgggcaggccgccgaccugaaguccacccaggccgccaucaaccagaucaacggcaagcugaaccgccucaucggcaagaccaacgagaaguuccaccagaucgagaaggaguucagcgagguggaggggcggauccaggaccuggagaaguacguggaggacacgaagaucgaccugugguccuacaacgcggagcuccuggucgcccuggagaaccagcacaccaucgaccucaccgacagcgagaugaacaagcuguucgagcgcaccaagaagcagcugcgcgagaacgccgaggacaugggcaacgggugcuucaagaucuaccacaagugcgacaacgccugcaucggcuccauccggaacgggacguacgaccacgacguguaccgcgacgaggcccucaacaaccgguuccagaucaagggcguggagcugaaguccggcuacaaggacuggauccuguggaucagcuucgcgaucuccugcuuccuccugugcgucgcccugcucggguucaucaugugggccugccagaagggcaacauccgcugcaacaucugcaucuga

SEQ ID NO: 63602 - RNA, 1701 nt, Artificial Sequence
  derived and/or modified sequence opt1 from hemagglutinin__InfluenzaA__ACO36496
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacggcuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucucccuguacgcgcaggccagcggccggaucaccguguccacgaagcgcagccagcagaccgugaucccgaacaucgggagccggccccgcguccgggacaucuccagccgcaucuccaucuacuggaccaucgugaagcccggcgacauccugcucaucaacagcaccgggaaccugaucgcgccccggggcuacuucaagauccgcuccggcaagagcuccaucaugcggagcgacgccccgaucgggaagugcaacuccgagugcaucacgcccaacggcagcauccccaacgacaagcccuuccagaacgugaaccgcaucaccuacggggccugcccgcgguacgucaagcagaacacccugaagcucgccaccggcaugcgcaacgugcccgagacgcagacccgggggaucuucggcgccaucgccggcuucaucgagaacgggugggagggcaugguggacgggugguacggcuuccgccaccagaacuccgaggggaccggccaggccgccgaccugaaguccacccaggcggccaucaaccagaucaacggcaagcugaaccggcucaucgggaagacgaacgagaaguuccaccagaucgagaaggaguucuccgaggucgagggccgcauccaggaccuggagaaguacguggaggacaccaagaucgaccuguggagcuacaacgccgagcuccugguggcccuggagaaccagcacaccaucgaccucaccgacuccgagaugaacaagcuguucgagcggacgaagaagcagcugcgcgagaacgccgaggacauggggaacggcugcuucaagaucuaccacaagugcgacaacgcgugcaucgggagcauccgcaacggcaccuacgaccacgacgucuaccgggacgaggcccucaacaaccgcuuccagaucaagggcguggagcugaaguccggguacaaggacuggauccuguggaucagcuucgccaucuccugcuuccuccugugcguggcccugcucggcuucaucaugugggccugccagaaggggaacauccggugcaacaucugcaucuga

SEQ ID NO: 63603 - RNA, 1701 nt, Artificial Sequence
  derived and/or modified sequence opt1 from hemagglutinin__InfluenzaA__ACO36518
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugcccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacgggaccugcccccgguacgugaagcagaacacccugaagcucgccacgggcaugcgcaacgugcccgagaagcagacccggggcaucuucggggcgaucgccggcuucaucgagaacggcugggaggggauggucgacggcugguacggguuccgccaccagaacuccgagggcaccgggcaggccgccgaccugaaguccacccaggccgcgaucaaccagaucaacggcaagcugaaccggcucaucggcaagacgaacgagaaguuccaccagaucgagaaggaguucuccgagguggaggggcgcauccaggaccuggagaaguacguggaggacaccaagaucgaccuguggagcuacaacgccgagcuccuggucgcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgccugcaucggcagcauccgcaacgggaccuacgaccacgacguguaccgggacgaggcgcucaacaaccgcuuccagaucaagggcguggagcugaagcugggcuacaaggacuggauccucuggaucuccuucgccaucagcugcuuccugcugugcgucgcccuccugggguucaucaugugggccugccagaagggcaacauccggugcaacaucugcaucuga

SEQ ID NO: 63604 - RNA, 1701 nt, Artificial Sequence
  derived and/or modified sequence opt1 from hemagglutinin__InfluenzaA__ACO36551
augaagaccaucaucgcccugagccacauccucugccugguguucgcccagaagcccccgggcaacgacaacuccaccgcgacgcugugccucgggcaccacgccguccccaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuacccguacgacgugcccgacuacgcgagccugcggucccuggucgccagcuccgggacgcucgaguucaacaacgagagcuucaacuggaccggcgugacccagaacgggaccuccagcgccugcaagcgccgguccaacaacagcuucuucucccgccugaacuggcugacgcaccucaaguucaaguaccccgcccugaacgugaccaugcccaacaacgagaaguucgacaagcuguacaucuggggcguccaccacccggggaccgacaacgaccagaucagccucuacgcgcaggccuccggccggaucaccgugagcacgaagcgcagccagcagaccgugauccccaacaucggcucccggccccgcguccgggacaucagcucccgcaucagcaucuacuggaccaucgugaagcccggggacauccugcugaucaacuccaccggcaaccucaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcuggcgaccgggaugcgcaacgugcccgagacgcagacccggggcaucuucggggccaucgccggcuucaucgagaacggcugggaggggaugguggacggcugguacggguuccgccaccagaacagcgagggcaccgggcaggccgccgaccucaaguccacccaggcggccaucaaccagaucaacggcaagcugaaccggcugaucggcaagacgaacgagaaguuccaccagaucgagaaggaguucagcgaggucgaggggcgcauccaggaccucgagaaguacguggaggacaccaagaucgaccugugguccuacaacgccgagcugcucguggcccuggagaaccagcacaccaucgaccugaccgacagcgagaugaacaagcuguucgagcggacgaagaagcagcuccgcgagaacgccgaggacaugggcaacgggugcuucaagaucuaccacaagugcgacaacgcgugcaucggcuccauccgcaacgagaccuacgaccacgacgucuaccgggacgaggcccugaacaaccgcuuccagaucaaggggguggagcucaagagcggcuacaaggacuggauccuguggaucuccuucgccaucagcugcuuccugcucugcguggcccugcugggcuucaucaugugggccugccagaaggggaacauccggugcaacaucugcaucuga

SEQ ID NO: 63605 - RNA, 1701 nt, Artificial Sequence
  derived and/or modified sequence opt1 from hemagglutinin__InfluenzaA__ACO36562
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagacgcagacccggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagacgaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacaccaucgaccucaccgacuccgagaugaacaagcuguucgagcggacgaagaagcagcugcgcgagaacgccgaggacaugggcaacgggugcuucaagaucuaccacaagugcgacaacgcgugcaucggcagcauccgcaacgagaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 63606 - RNA, 1701 nt, Artificial Sequence
  derived and/or modified sequence opt1 from hemagglutinin__InfluenzaA__ACO36573
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacaucagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagacgcagacccggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagacgaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucaccgacagcgagaugaacaagcuguucgagcggacgaagaagcagcugcgcgagaacgccgaggacaugggcaacgggugcuucaagaucuaccacaagugcgacaacgcgugcaucggcuccauccgcaacgagaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 63607 - RNA, 1701 nt, Artificial Sequence
  derived and/or modified sequence opt1 from hemagglutinin__InfluenzaA__ACO36584
augaagaccaucaucgcccugagcuacauccucugccugguguucucccagaagcugcccggcaacgacaacagcaccgccacgcucugccuggggcaccacgcggucccgaacggcaccaucgugaagaccaucaccaacgaccagaucgaggugacgaacgccaccgagcugguccaguccagcuccaccgggggcaucugcgacagcccccaccagauccucgacggggagaacugcacccugaucgacgcccugcucggcgacccccagugcgacggcuuccagaacaagaagugggaccuguucguggagcgcuccaaggccuacagcaacugcuaccccuacgacgugccggacuacgccucccugcggagccucgucgcguccagcgggacgcuggaguucaacaacgaguccuucaacuggaccggcgugacccagaacgggaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucucccuguacgcccaggcgagcggccggaucaccgugagcacgaagaagucccagcagaccgugaucccgaacaucggcagccgcccccggguccgcgacaucuccagccggaucuccaucuacuggaccaucgugaagcccggggacauccugcucaucaacagcaccggcaaccugaucgcgccccgcggguacuucaagauccgguccggcaagagcuccaucaugcgcagcgacgccccgaucggcaagugcaacuccgagugcaucacgcccaacgggagcauccccaacgacaagcccuuccagaacgugaaccggaucaccuacggcgccugcccgcgcuacgucaagcagaacacccugaagcucgccaccgggaugcggaacgugcccgagacgcagacccgcggcaucuucggggccaucgccggcuucaucgagaacggcugggaggggaugguggacggcugguacggguuccggcaccagaacuccgagggcaccgggcaggccgccgaccucaagagcacccaggccgcgaucaaccagaucaacggcaagcugaaccgccugaucggcaagacgaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacaccaucgaccucaccgacuccgagaugaacaagcuguucgagcgcacgaagaagcagcugcgggagaacgccgaggacaugggcaacgggugcuucaagaucuaccacaagugcgacaacgccugcaucggcagcauccgcaacgagaccuacgaccacgacgucuaccgcgacgaggcgcucaacaaccgguuccagaucaaggggguggagcugaaguccggcuacaaggacuggauccuguggaucagcuucgccaucagcugcuuccuccugugcguggcccugcucggcuucaucaugugggccugccagaaggggaacauccgcugcaacaucugcaucuga

SEQ ID NO: 63608 - RNA, 1701 nt, Artificial Sequence; identical to SEQ ID NO: 61638
  derived and/or modified sequence opt1 from hemagglutinin__InfluenzaA__ACO36595

SEQ ID NO: 63609 - RNA, 1701 nt, Artificial Sequence
  derived and/or modified sequence opt1 from hemagglutinin__InfluenzaA__ACO36606
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaagaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgcagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 63610 - RNA, 1701 nt, Artificial Sequence; identical to SEQ ID NO: 61638
  derived and/or modified sequence opt1 from hemagglutinin__InfluenzaA__ACO36617

SEQ ID NO: 63611 - RNA, 1701 nt, Artificial Sequence; identical to SEQ ID NO: 61638
  derived and/or modified sequence opt1 from hemagglutinin__InfluenzaA__ACO36628

SEQ ID NO: 63612 - RNA, 1701 nt, Artificial Sequence
  derived and/or modified sequence opt1 from hemagglutinin__InfluenzaA__ACO36639
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcuucgcccugcucggguucaucaugugggccugccagaagggcaacauccggugcaacaucugcaucuga

SEQ ID NO: 63613 - RNA, 1701 nt, Artificial Sequence
  derived and/or modified sequence opt1 from hemagglutinin__InfluenzaA__ACO36661
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaucaagaucgaccugugguccuacaacgccgagcuccugguggcccuggagaaccagcacaccaucgaccucacggacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 63614 - RNA, 1701 nt, Artificial Sequence; identical to SEQ ID NO: 61638
  derived and/or modified sequence opt1 from hemagglutinin__InfluenzaA__ACO36683

SEQ ID NO: 63615 - RNA, 1701 nt, Artificial Sequence; identical to SEQ ID NO: 63605
  derived and/or modified sequence opt1 from hemagglutinin__InfluenzaA__ACO37122

SEQ ID NO: 63616 - RNA, 1701 nt, Artificial Sequence
  derived and/or modified sequence opt1 from hemagglutinin__InfluenzaA__ACO94514
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcaaguccaacaacagcuucuucucccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 63617 - RNA, 1701 nt, Artificial Sequence
  derived and/or modified sequence opt1 from hemagglutinin__InfluenzaA__ACO94515
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgcaaguccaacaacagcuucuucucccggcugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcgcaucaccguguccacgaagcggagccagcagaccgugaucccgaacaucggcagccgcccccggguccgcaacauccccucccggaucagcaucuacuggaccaucgugaagcccggcgacauccugcucaucaacuccaccgggaaccugaucgccccgcgcggcuacuucaagauccggagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugauggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacguguaccgcgacgaggcccucaacaaccgguuccagaucaagggggucgagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 63618 - RNA, 1701 nt, Artificial Sequence; identical to SEQ ID NO: 63442
  derived and/or modified sequence opt1 from hemagglutinin__InfluenzaA__ACO94516

SEQ ID NO: 63619 - RNA, 1701 nt, Artificial Sequence; identical to SEQ ID NO: 63442
  derived and/or modified sequence opt1 from hemagglutinin__InfluenzaA__ACO94672

SEQ ID NO: 63620 - RNA, 1701 nt, Artificial Sequence
  derived and/or modified sequence opt1 from hemagglutinin__InfluenzaA__ACO94683
augaagaccaucaucgcccugagcuacauccucugccugguguccgcccagaagcugcccggcaacgacaacagcaccgcgacgcucugccuggggcaccacgccgucccgaacggcaccaucgugaagaccaucaccaacgaccagaucgaggugacgaacgccaccgagcugguccaguccagcuccaccggggagaucugcgacagcccccaccaggugcucgacggcgagaacugcacccugaucgacgcccugcucggggacccccagugcgacggcuuccagaacaagaagugggaccuguucguggagcgcuccaaggccuacagcaacugcuaccccuacgacgucccggacuacgcgucccugcggagccucguggccuccagcggcacgcuggaguucaacaacgaguccuucaacuggaccggggugacccagaacggcaccagcuccgccugcauccgccggagcaacaacuccuucuucagccgccugaacuggcucacgcacuccaaguucaaguaccccgcccugaacgucaccaugcccaacaacgaggaguucgacaagcuguacaucuggggcgugcaccaccccgggaccgacaacgaccagaucuuccucuacgcgcaggccagcgggcggaucaccgugagcacgaagcgcucccagcagaccgucaucccgaacaucggcagccggccccgcgugcggaacauccccucccgcaucagcaucuacuggaccaucgugaagcccggcgacauccugcugaucaacuccaccgggaaccucaucgccccgcggggcuacuucaagauccgcagcgggaaguccagcaucaugcgguccgacgcccccaucggcaagugcaacagcgagugcaucacgcccaacggcuccauccccaacgacaagccguuccagaacgucaaccgcaucaccuacggggccugcccccgguacgugaagcagaacacccugaagcuggcgaccggcaugcgcaacgugcccgagaagcagacgcgggggaucuucggcgccaucgccggguucaucgagaacggcugggagggcauggucgacgggugguacggcuuccgccaccagaacagcgaggggaucggccaggccgccgaccucaaguccacccaggcggccaucgaccagaucaacgggaagcugaaccggcugaucggcaagaccaacgagaaguuccaccagaucgagaaggaguucaccgagguggagggccgcauccaggaccucgagaaguacguggaggacacgaagaucgaccuguggagcuacaacgccgagcugcucgucgcccuggagaaccagcacaccaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcacguacgaccacgagguguaccgcgacgaggcccugaacaaccgguuccagaucaaggggguggagcucaaguccggcuacaaggacuggauccuguggaucagcuucgccaucuccugcuuccugcucugcgucgcccugcugggcuucaucaugugggccugccagaaggggaacauccgcugcaacaucugcaucuga

SEQ ID NO: 63621 - RNA, 1701 nt, Artificial Sequence; identical to SEQ ID NO: 63442
  derived and/or modified sequence opt1 from hemagglutinin__InfluenzaA__ACO94694

SEQ ID NO: 63622 - RNA, 1698 nt, Artificial Sequence; identical to SEQ ID NO: 63496
  derived and/or modified sequence opt1 from hemagglutinin__InfluenzaA__ACO94705

SEQ ID NO: 63623 - RNA, 1701 nt, Artificial Sequence
  derived and/or modified sequence opt1 from hemagglutinin__InfluenzaA__ACO94727
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugaaguccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugccuccugcugugcguggcccuccugggcuucaucaugugggccugccagaaggggaacauccgcugcaacaucugcaucuga

SEQ ID NO: 63624 - RNA, 1701 nt, Artificial Sequence
  derived and/or modified sequence opt1 from hemagglutinin__InfluenzaA__ACO94738
augaagaccaucaucgcccugagcuacauccagugccucguguucgcccagaaguuccccggcaacgacaacuccaccgcgacgcugugccuggggcaccacgccgucccgaacggcaccguggugaagaccaucaccaacgaccagaucgaggucacgaacgccaccgagcucgugcagagcuccagcaccggggagaucugcgacagcccccaccagauccuggacggcgagaacugcacccugaucgacgcccuccugggggacccccagugcgacggcuuccagaacaagaacugggaccuguucguggagcgcagcaaggccuacuccaacugcuaccccuacgacgucccggacuacgcgagccuccggucccugguggccagcuccggcacgcuggaguucaacaacgagagcuucaacuggaccggggugacccagaacggcaccuccagcgccugcauccgccgguccaacaacagcuucuucucccgccucaacuggcugacgcacagcaaguucaaguaccccgcccugaacgucaccaugcccaacaacgagaacuucgacaagcucuacaucuggggcgugcaccaccccgggaccgacaacgaccagaucuuccuguacgcgcgggccuccgggcgcaucaccgugagcacgaagcggagccagcagaccgucaucccgaacaucggcucccgcccccgggugcgcaacauccccagccggaucuccaucuacuggaccaucgugaagcccggcgacauccugcucaucaacagcaccgggaaccugaucgccccgcgcggcuacuucaagauccgguccgggaaguccuccaucaugcgcagcgacgcccccaucggcaagugcaacuccgagugcaucacgcccaacggcagcauccccaacgacaagccguuccagaacgucaaccggaucaccuacggggccugcccccgcuacgugaagcagaacacccugaagcucgcgaccggcaugcggaacgugcccgagaagcagacgcgcgggaucuucggcgccaucgccggguucaucgagaacggcugggagggcauggucgacgggugguacggcuuccggcaccagaacuccgaggggaucggccaggccgccgaccucaagagcacccaggcggccaucgaccagaucaacgggaagcugaaccgccugaucggcaagaccaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccgcaacggcaccuacgaccacgacguguaccgggacgaggcccucaacaaccgcuuccagaucaaggggguggagcugaaguccggcuacaaggacuggauccuguggaucagcuucgccaucuccugcuuccuccugugcaucgcccugcucggcuucaucaugugggccugccagaaggggaacauccggugcaacaucugcaucuga

SEQ ID NO: 63625 - RNA, 1701 nt, Artificial Sequence; identical to SEQ ID NO: 63545
  derived and/or modified sequence opt1 from hemagglutinin__InfluenzaA__ACO94760

SEQ ID NO: 63626 - RNA, 1701 nt, Artificial Sequence
  derived and/or modified sequence opt1 from hemagglutinin__InfluenzaA__ACO94771
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugccuccugcugugcguggcccuccugggcuucaucaugugggccugccagaaggggaacauccggugcaacaucugcaucuga

SEQ ID NO: 63627 - RNA, 1701 nt, Artificial Sequence; identical to SEQ ID NO: 63442
  derived and/or modified sequence opt1 from hemagglutinin__InfluenzaA__ACO94782

SEQ ID NO: 63628 - RNA, 1701 nt, Artificial Sequence; identical to SEQ ID NO: 63442
  derived and/or modified sequence opt1 from hemagglutinin__InfluenzaA__ACO94793

SEQ ID NO: 63629 - RNA, 1698 nt, Artificial Sequence
  derived and/or modified sequence opt1 from hemagglutinin__InfluenzaA__ACO94804
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagccgcgaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacgaccaccggggucuccgccagcugcucccacaacggcgagagcuccuucuacaagaaccugcuguggcucaccgggaagaacggccuguaccccaaccugagcaaguccuacgccaacaacaaggagaaggaggugcucgugcuguggggcguccaccacccgcccaacaucggcaaccagcgggcccuguaccacacggagaacgccuacgugagcguggucagcucccacuacagccgcaaguucacccccgagaucgccaagcggcccaaggugcgcgaccaggagggccggaucaacuacuacuggacccuccuggagcccggggacaccaucaucuucgaggcgaacggcaaccugaucgccccgcgcuacgccuucgcccucucccggggguucggcagcggcaucaucaacuccaacgcccccauggacgggugcgacgcgaagugccagacgccccagggcgccaucaacagcucccugcccuuccagaacgugcacccggucaccaucggggagugccccaaguacgugcgcagcgccaagcugcggauggugaccggccuccgcaacauccccuccauccagagccgggggcuguucggcgccaucgccggcuucaucgagggcggguggaccgggauggucgacggcugguacggguaccaccaccagaacgagcagggcuccggcuacgcggccgaccagaaguccacgcagaacgccaucaacgggaucaccaacaaggugaacagcgugaucgagaagaugaacacccaguucaccgccgucggcaaggaguucaacaagcuggagcgccggauggagaaccucaacaagaagguggacgacggguucaucgacaucuggacguacaacgccgagcugcugguccuccuggagaacgagcgcacccuggacuuccacgacagcuacgugaagaaccucuacgagaaggugaagucccagcugaagaacaacgcgaaggagaucggcaacgggugcuucgaguucuaccacaagugcaacgacgagugcauggagagcgucaagaacggcaccuacgacuaccccaaguacuccgaggagagcaagcugaaccgggagaagaucgacggcgugaagcucgaguccauggggguguaccagauccuggccaucuacagcaccgucgccagcucccuggugcuccuggugagccugggcgccaucuccuucuggaugugcagcaacgggucccuccagugccgcaucugcaucuga

SEQ ID NO: 63630 - RNA, 1701 nt, Artificial Sequence; identical to SEQ ID NO: 63309
  derived and/or modified sequence opt1 from hemagglutinin__InfluenzaA__ACO94815

SEQ ID NO: 63631 - RNA, 1701 nt, Artificial Sequence; identical to SEQ ID NO: 63316
  derived and/or modified sequence opt1 from hemagglutinin__InfluenzaA__ACO94848

SEQ ID NO: 63632 - RNA, 1698 nt, Artificial Sequence; identical to SEQ ID NO: 63496
  derived and/or modified sequence opt1 from hemagglutinin__InfluenzaA__ACO94859

SEQ ID NO: 63633 - RNA, 1698 nt, Artificial Sequence
  derived and/or modified sequence opt1 from hemagglutinin__InfluenzaA__ACO94870
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggggaaggaggugcucguccuguggggcgugcaccacccgcccaacaucggcgaccagaacacccuguaccacacggagaacgccuacgugagcgucgugagcucccacuacagccggaaguucacccccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucaaccgcggcuucggcuccgggaucaucaacagcaacgcccccauggacaagugcgacgccaagugccagacgccccagggcgcgaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggcuggaccgggaugguggacggcugguacggguaccaccaccagaacgagcagggcagcggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaaccgcgagaagaucgacggcgugaagcucgagagcaugggggucuaccagauccuggcgaucuacuccaccguggccagcagccuggugcuccuggucucccugggcgccaucagcuucuggaugugcuccaacgggagccuccagugccggaucugcaucuga

SEQ ID NO: 63634 - RNA, 1701 nt, Artificial Sequence
  derived and/or modified sequence opt1 from hemagglutinin__InfluenzaA__ACO94881
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcuccugcaagcgccggagcaacaacuccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcccaggcgagcggccggaucaccguguccacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggccgcgaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccaccgcugcgacaacgccugcaucggcuccauccggaacgggacguacgaccacgacguguaccgcgacgaggcgcucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 63635 - RNA, 1701 nt, Artificial Sequence
  derived and/or modified sequence opt1 from hemagglutinin__InfluenzaA__ACO94892
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugccagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcagaccuccggccggaucacgaucagcaccaagcgcagccagcagaccgugaucccgaacaucggcucccggccccgcgugcgggacguccccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucgugaagugcaacuccgagugcaucacccccaacggcagcauccccaacgacaagccguuccagaacgucaaccgcaucaccuacggggccugcccccgguacgugaagcagaacacccugaagcucgccacgggcaugcgcaacgugcccgagcggcagacccgcgggaucuucggcgcgaucgccggguucaucgagaacggcugggagggcauggucgacgggugguacggcuuccggcaccagaacuccgaggggaccggccaggccgccgaccugaaguccacccaggccgcgaucaaccagaucaacgggaagcugaaccgccucaucggcaagacgaacgagaaguuccaccagaucgagaaggaguucuccgagguggagggccggauccaggaccuggagaaguacguggaggacaccaagaucgaccuguggagcuacaacgccgagcuccuggucgcccuggagaaccagcacaccaucgaccucaccgacuccgagaugaacaagcuguucgagcgcacgaagaagcagcugcgcgagaacgccgaggacauggggaacggcugcuucaagaucuaccacaagugcgacaacgccugcaucgggagcauccggaacggcaccuacgaccacgacguguaccgcgacgaggcgcucaacaaccgguuccagaucaaggggguggagcugaaguccggcuacaaggacuggauccuguggaucagcuucgccaucuccugcuuccuccugugcgucgcccugcucggcuucaucaugugggccugccagaaggggaacauccgcugcaacaucugcaucuga

SEQ ID NO: 63636 - RNA, 1701 nt, Artificial Sequence
  derived and/or modified sequence opt1 from hemagglutinin__InfluenzaA__ACO94903
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcgaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugcccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 63637 - RNA, 1701 nt, Artificial Sequence
  derived and/or modified sequence opt1 from hemagglutinin__InfluenzaA__ACO94925
augaagaccaucaucgcccugagcuacauccucugccugguguucgcccagaagcugcccggcaacgacaacuccaccgcgacgcucugccuggggcaccacgccgucccgaacggcaccguggugaagaccaucaccaacgaccagaucgaggucacgaacgccaccgagcuggugcagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgucccggacuacgcgagccugcggucccucguggccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucagccuguacgcgcaggccuccggccggaucaccgugagcacgaagcgcagccagcagaccgucaucccgaacaucggcucccggccccgcgugcgggacgugcccagccgcaucuccaucuacuggaccaucgucaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacgucgaggacacgaagaucgaccuguggagcuacaacgccgagcuccugguggcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 63638 - RNA, 1701 nt, Artificial Sequence
  derived and/or modified sequence opt1 from hemagglutinin__InfluenzaA__ACO94936
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggaggacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcuccugcaagcgccggagcaacaacuccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcccaggcgagcggccggaucaccguguccacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggccgcgaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgccugcaucggcuccauccgcaacgggacguacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 63639 - RNA, 1701 nt, Artificial Sequence
  derived and/or modified sequence opt1 from hemagglutinin__InfluenzaA__ACO94947
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugcccagccgcaucuccaucuacuggaccaucgugaagcccggggacauccugcucaucaacagcaccggcaaccugaucgccccgcggggguacuuccgcauccgguccggcaagagcuccaucaugcgcagcgacgcccccaucggcaagugcaacuccgagugcaucacgcccaacgggagcauccccaacgacaagccguuccagaacgucaaccggaucaccuacggcgccugcccccgcuacgugaagcagaacacccugaagcucgcgaccgggaugcggaacgugcccgagaagcagacgcgcggcaucuucggggccaucgccggcuucaucgagaacggcugggaggggauggucgacggcugguacggguuccggcaccagaacuccgagggcaccgggcaggccgccgaccugaaguccacccaggcggccaucaaccagaucaacggcaagcugaaccgccucaucggcaagaccaacgagaaguuccaccagaucgagaaggaguucuccgagguggaggggcggauccaggaccuggagaaguacguggaggacacgaagaucgaccuguggagcuacaacgccgagcuccuggucgcccuggagaaccagcacaccaucgaccucaccgacuccgagaugaacaagcuguucgagcgcaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgguuccagaucaagggcguggagcugaaguccggcuacaaggacuggauccuguggaucagcuucgccaucuccugcuuccuccugugcgucgcccugcucggguucaucaugugggccugccagaagggcaacauccgcugcaacaucugcaucuga

SEQ ID NO: 63640 - RNA, 1701 nt, Artificial Sequence
  derived and/or modified sequence opt1 from hemagglutinin__InfluenzaA__ACO95153
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaacuucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacaucagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagacgcagacccggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagacgaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucaccgacagcgagaugaacaagcuguucgagcggacgaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 63641 - RNA, 1701 nt, Artificial Sequence; identical to SEQ ID NO: 63606
  derived and/or modified sequence opt1 from hemagglutinin__InfluenzaA__ACO95171

SEQ ID NO: 63642 - RNA, 1701 nt, Artificial Sequence
  derived and/or modified sequence opt1 from hemagglutinin__InfluenzaA__ACO95193
augaagaccaucaucgcccugagcuacauccucugccugguguucgcccagaagcugcccggcaacgacaaguccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagaacuucaacuggaccggcgugacccagaacgggaccagcuccgccugcaagcgccggagcaacaacuccuucuucagccgccugaacuggcucacgcaccugaaguucaaguaccccgcccugaacgugaccaugcccaacaacgagaaguucgacaagcucuacaucuggggcguccaccaccccgggaccgacaacgaccagaucucccuguacgcgcaggccagcggccggaucaccguguccacgaagcgcagccagcagaccgugaucccgaacaucggcagccggccccgcguccgggacaucuccagccgcaucuccaucuacuggaccaucgugaagcccggggacauccugcucaucaacagcaccggcaaccugaucgcgccccggggguacuucaagauccgcuccggcaagagcuccaucaugcggagcgacgccccgaucggcaagugcuccagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagacgcagacccggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagacgaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucaccgacagcgagaugaacaagcuguucgagcggacgaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 63643 - RNA, 1701 nt, Artificial Sequence; identical to SEQ ID NO: 63605
  derived and/or modified sequence opt1 from hemagglutinin__InfluenzaA__ACO95204

SEQ ID NO: 63644 - RNA, 1701 nt, Artificial Sequence
  derived and/or modified sequence opt1 from hemagglutinin__InfluenzaA__ACO95215
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcgugcaccaccccgggaccgacaacgaccagaucagccuguacgcgcaggccuccggccggaucaccgucagcacgaagcgcagccagcagaccgugaucccgaacaucggcucccggccccgcgugcgggacaucagcucccgcaucagcaucuacuggaccaucgucaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgugaaccgcaucaccuacggcgccugcccgcgguacgugaagcagaacacccugaagcucgccaccgggaugcgcaacguccccgagacgcagacccggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagacgaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacaccaucgaccucaccgacagcgagaugaacaagcuguucgagcggacgaagaagcagcugcgcgagaacgccgaggacaugggcaacgggugcuucaagaucuaccacaagugcgacaacgcgugcaucggcuccauccgcaacgagaccuacgaccacgacguguaccgggacgaggcccucaacaaccgcuuccagaucaagagcgucgagcugaaguccggguacaaggacuggauccuguggaucagcuucgccaucagcugcuuccuccugugcguggcccugcucggcuucaucaugugggccugccagaagggcaacauccggugcaacaucugcaucuga

SEQ ID NO: 63645 - RNA, 1701 nt, Artificial Sequence; identical to SEQ ID NO: 61289
  derived and/or modified sequence opt1 from hemagglutinin__InfluenzaA__ACO95226

SEQ ID NO: 63646 - RNA, 1701 nt, Artificial Sequence; identical to SEQ ID NO: 61638
  derived and/or modified sequence opt1 from hemagglutinin__InfluenzaA__ACO95248

SEQ ID NO: 63647 - RNA, 1701 nt, Artificial Sequence
  derived and/or modified sequence opt1 from hemagglutinin__InfluenzaA__ACO95270
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgccagccugcggucccucgucgcgagcuccggcacccuggaguucaacaacgagagcuucaacuggaccggggugacccagaacggcacguccagcgccugcauccgccgguccaacaacagcuucuucucccgccugaacuggcucacccaccugaaguucaaguaccccgcccugaacgugaccaugcccaacaacgagaaguucgacaagcucuacaucuggggcguccaccaccccgugaccgacaacaaccagaucuuccuguacgcccaggcgagcgggcggaucacgguguccaccaagcgcagccagcagaccgucaucccgaacaucgggagccggccccgcgugcggaacauccccucccgcaucagcaucuacuggaccaucgugaagcccggcgacauccugcucaucaacuccacgggcaaccugaucgccccgcggggguacuucaagauccgcagcggcaaguccagcaucaugcgguccgacgcccccaucgggaagugcaacagcgagugcaucacccccaacggcuccauccccaacgacaagccguuccagaacgucaaccgcaucaccuacggcgccugcccccgguacgugaagcagaacacccugaagcucgccacggggaugcgcaacgugcccgagaagcagacccggggcaucuucggggcgaucgccggcuucaucgagaacgggugggagggcauggucgacggcugguacggguuccgccaccagaacagcgagggcaucgggcaggccgccgaccugaaguccacccaggccgcgaucgaccagaucaacggcaagcugaaccggcucaucgggaagaccaacgagaaguuccaccagaucgagaaggaguucagcgagguggagggccgcauccaggaccuggagaaguacguggaggacacgaagaucgaccugugguccuacaacgccgagcuccuggucgcccuggagaaccagcacaccaucgaccucaccgacagcgagaugaacaagcuguucgagaagaccaagaagcagcugcgggagaacgccgaggacaugggcaacgggugcuucaagaucuaccacaagugcgacaacgccugcaucggcuccauccgcaacgggacguacgaccacgacguguaccgcgacgaggcgcucaacaaccgguuccagaucaagggcguggagcugaaguccggguacaaggacuggauccuguggaucuccuucgccaucagcugcuuccuccugugcgucgcccugcucggcuucaucaugugggccugccagaagggcaacauccgcugcaacaucugcaucuga

SEQ ID NO: 63648 - RNA, 1701 nt, Artificial Sequence; identical to SEQ ID NO: 63442
  derived and/or modified sequence opt1 from hemagglutinin__InfluenzaA__ACO95281

SEQ ID NO: 63649 - RNA, 1701 nt, Artificial Sequence
  derived and/or modified sequence opt1 from hemagglutinin__InfluenzaA__ACO95292
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccagagcgggaaguccagcaucaugcgcuccgacgcccccaucggcaagugcaacagcgagugcaucacgcccaacggcuccauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 63650 - RNA, 1701 nt, Artificial Sequence; identical to SEQ ID NO: 63545
  derived and/or modified sequence opt1 from hemagglutinin__InfluenzaA__ACO95303

SEQ ID NO: 63651 - RNA, 1698 nt, Artificial Sequence
  derived and/or modified sequence opt1 from hemagglutinin__InfluenzaA__ACO95382
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggagggguccuggcccaaccacacggucaccggcgugagcgccuccugcagccacaacggggaguccagcuucuaccgcaaccugcuguggcucaccggcaagaacgggcuguaccccaaccuguccaagagcuacgccaacaacaaggagaaggaggugcucguccuguggggcgugcaccacccgcccaacaucggcgaccagaaggcccuguaccacaccgagaacgccuacguguccgucgugagcagccacuacucccggaaguucacgcccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucagccgcggcuucggcuccgggaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggcuggaccgggaugguggacggcugguacggguaccaccaccagaacgagcagggcagcggcuacgcggccgaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggcgugaagcucgagagcaugggggucuaccagauccuggccaucuacuccaccguggccagcagccuggugcuccuggucucccugggcgccaucagcuucuggaugugcuccaacgggagccuccagugccggaucugcaucuga

SEQ ID NO: 63652 - RNA, 1698 nt, Artificial Sequence
  derived and/or modified sequence opt1 from hemagglutinin__InfluenzaA__ACO95415
augaaggugaagcugcucguccugcugugcaccuucaccgccacguacgccgacaccaucugcaucggcuaccacgcgaacaacagcaccgacaccaucgacacggugcucgagaagaacgugaccgucacccacuccgugaaccugcuggagaacagccacaacgggaagcucugccugcugaagggcaucgcgccccuccagcuggggaacugcuccguggccggcuggauccuggggaacccggagugcgagcuccugaucagcaaggaguccuggagcuacaucgucgagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggugaccggggucuccgccagcugcucccacaacggcgagagcuccuucuaccgcaaccugcuguggcucaccgggaagaacggccuguaccccaaccugagcaaguccuacgccaacaacaaggggaaggaggugcucgugcuguggggcguccaccacccgcccaacaucggcgaccagaacacccuguaccacacggagaacgccuacgugagcguggucagcucccacuacagccggaaguucacccccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucucccgcggcuucggcagcgggaucaucaacuccaacgcccccauggacaagugcgacgccaagugccagacgccccagggcgcgaucaacagcucccugcccuuccagaacgugcacccggucaccaucggggagugccccaaguacgugcggagcgccaagcugcgcauggugaccggccuccggaacauccccuccauccagagccgcgggcuguucggcgccaucgccggcuucaucgagggcggcuggaccgggauggucgacggcugguacggguaccaccaccagaacgagcagggcuccggcuacgccgcggaccagaaguccacgcagaacgccaucaacgggaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgccgagcugcugguccuccuggagaacgagcggacccuggacuuccacgacagcaacgugaagaaccucuacgagaaggugaagucccagcugaagaacaacgccaaggagaucggcaacgggugcuucgaguucuaccacaagugcaacgacgagugcauggagagcgucaagaacggcaccuacgacuaccccaaguacuccgaggagagcaagcugaaccgcgagaagaucgacggcgugaagcucgaguccauggggguguaccagauccuggcgaucuacagcaccgucgccagcucccuggugcuccuggugagccugggcgccaucuccuucuggaugugcagcaacgggucccuccagugccggaucugcaucuga

SEQ ID NO: 63653 - RNA, 1701 nt, Artificial Sequence
  derived and/or modified sequence opt1 from hemagglutinin__InfluenzaA__ACO95426
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucgacuggaccggcgugacccagaacgggaccuccagcuccugcaagcgccggagcaacaacuccuucuucagccgccugaacuggcucacgcaccugaaguacaaguaccccgcccugaacgugaccaugcccaacaacgagaaguucgacaagcucuacaucuggggcguccaccaccccgggaccgacuccgaccagaucagccuguacgcccaggcgagcggccggaucaccguguccacgaagcgcagccagcagaccgugaucccgaacaucggcucccggccccgcguccgggacgugagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggccgcgaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgccugcaucggcuccauccgcaacgggacguacgaccacgacguguaccgggacgaggcgcucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 63654 - RNA, 1701 nt, Artificial Sequence; identical to SEQ ID NO: 62803
  derived and/or modified sequence opt1 from hemagglutinin__InfluenzaA__ACO95437

SEQ ID NO: 63655 - RNA, 1701 nt, Artificial Sequence
  derived and/or modified sequence opt1 from hemagglutinin__InfluenzaA__ACO95448
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagagcuucaacuggaccggcgucacccagaacgggaccuccagcgccugcaagcgccgguccaacaacagcuucuucucccgccugaacuggcucacgcaccugaaguucaaguaccccgcccugaacgugaccaugcccaacaacgaggaguucgacaagcucuacaucuggggcgugcaccaccccgggaccgacaacgaccagaucaaccuguacgcgcaggccagcggccggaucaccgucuccacgaagcgcagccagcagaccgugaucccgaacaucggcagccggccccgcgugcgggacauccccucccgcaucagcaucuacuggaccaucgucaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgugaagcagaacacccugaagcucgcgaccgggaugcgcaacguccccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucgaccagaucaacggcaagcugaaccggcucaucggcaagaccaacgagaaguuccaccagaucgagaaggaguucagcgagguggaggggcgcauccaggaccuggagaaguacgucgaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcgucgagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 63656 - RNA, 1701 nt, Artificial Sequence; identical to SEQ ID NO: 61638
  derived and/or modified sequence opt1 from hemagglutinin__InfluenzaA__ACO95459

SEQ ID NO: 63657 - RNA, 1701 nt, Artificial Sequence
  derived and/or modified sequence opt1 from hemagglutinin__InfluenzaA__ACO95470
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggccgcugcaacagcgagugcaucacgcccaacggguccauccccaacgacaagccguuccagaacgugaaccggaucaccuacggcgccugcccccgcuacgucaagcagaacacccugaagcucgcgaccgggaugcggaacgugcccgagaagcagacgcgcggcaucuucggggccaucgccggcuucaucgagaacggcugggaggggaugguggacggcugguacggguuccggcaccagaacagcgagggcaucgggcaggccgccgaccugaaguccacccaggcggccaucaaccagaucaacggcaagcugaaccgccucaucggcaagaccaacgagaaguuccaccagaucgagaaggaguucagcgaggucgaggggcggauccaggaccuggagaaguacguggaggacaccaagaucgaccugugguccuacaacgccgagcuccugguggcccuggagaaccagcacacgaucgaccucaccgacagcgagaugaacaagcuguucgagcgcaccaagaagcagcugcgcgagaacgccgaggacaugggcaacgggugcuucaagaucuaccacaagugcgacaacgcgugcaucggcuccauccggaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 63658 - RNA, 1701 nt, Artificial Sequence
  derived and/or modified sequence opt1 from hemagglutinin__InfluenzaA__ACO95481
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaaccugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcucaaccggcugaucggcaagaccaacgagaaguuccaccagaucgagaaggaguucagcgagguggaggggcgcauccaggaccuggagaaguacgucgaggacaccaagaucgaccucugguccuacaacgccgagcugcugguggcccucgagaaccagcacacgaucgaccugaccgacagcgagaugaacaagcuguucgagcggaccaagaagcagcuccgcgagaacgccgaggacaugggcaacgggugcuucaagaucuaccacaagugcgacaacgcgugcaucggcuccauccgcaacgggaccuacgaccacgacguguaccgggacgaggcccugaacaaccgcuuccagaucaagggcgucgagcugaaguccggcuacaaggacuggauccucuggaucuccuucgccaucagcugcuuccugcugugcguggcccuccugggguucaucaugugggccugccagaagggcaacauccggugcaacaucugcaucuga

SEQ ID NO: 63659 - RNA, 1701 nt, Artificial Sequence; identical to SEQ ID NO: 61638
  derived and/or modified sequence opt1 from hemagglutinin__InfluenzaA__ACO95492

SEQ ID NO: 63660 - RNA, 1701 nt, Artificial Sequence; identical to SEQ ID NO: 61638
  derived and/or modified sequence opt1 from hemagglutinin__InfluenzaA__ACO95503

SEQ ID NO: 63661 - RNA, 1701 nt, Artificial Sequence; identical to SEQ ID NO: 61638
  derived and/or modified sequence opt1 from hemagglutinin__InfluenzaA__ACO95514

SEQ ID NO: 63662 - RNA, 1701 nt, Artificial Sequence; identical to SEQ ID NO: 61638
  derived and/or modified sequence opt1 from hemagglutinin__InfluenzaA__ACO95536

SEQ ID NO: 63663 - RNA, 1701 nt, Artificial Sequence; identical to SEQ ID NO: 61638
  derived and/or modified sequence opt1 from hemagglutinin__InfluenzaA__ACO95547

SEQ ID NO: 63664 - RNA, 1701 nt, Artificial Sequence
  derived and/or modified sequence opt1 from hemagglutinin__InfluenzaA__ACP41963
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 63665 - RNA, 1698 nt, Artificial Sequence; identical to SEQ ID NO: 63651
  derived and/or modified sequence opt1 from hemagglutinin__InfluenzaA__ACP44192

SEQ ID NO: 63666 - RNA, 1698 nt, Artificial Sequence; identical to SEQ ID NO: 63651
  derived and/or modified sequence opt1 from hemagglutinin__InfluenzaA__ACP44203

SEQ ID NO: 63667 - RNA, 1698 nt, Artificial Sequence
  derived and/or modified sequence opt1 from hemagglutinin__InfluenzaA__ACP44225
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcggccuccugaucagcaaggaguccuggagcuacaucguggagaagcccaaccccgagaacgggaccugcuaccccgggcacuucgccgacuacgaggagcugcgcgagcagcucuccagcguguccagcuucgagcgguucgagaucuucccgaaggaguccagcuggcccaaccacacggucaccggcguguccgccagcugcucccacaacggggagagcuccuucuaccgcaaccugcuguggcucaccggcaagaacgggcuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucucccgcggcuucggcagcgggaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggcuggaccgggaugguggacggcugguacggguaccaccaccagaacgagcagggcuccggcuacgcggccgaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccaaggagagcaagcugaaccgcgagaagaucgacggcgugaagcucgaguccaugggggucuaccagauccuggccaucuacagcaccguggccagcucccuggugcuccuggucagccugggcgccaucuccuucuggaugugcagcaacgggucccuccagugccggaucugcaucuga

SEQ ID NO: 63668 - RNA, 1701 nt, Artificial Sequence
  derived and/or modified sequence opt1 from hemagglutinin__InfluenzaA__ACP44236
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccgacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugcccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgucaaccgcaucaccuacggcgccugcccccgguacgugaagcagaacacccugaagcucgcgaccgggaugcgcaacgugcccgagaagcagacgcggggcaucuucggggccaucgccggcuucaucgagaacggcugggaggggauggucgacggcugguacggguuccgccaccagaacuccgagggcaccgggcaggccgccgaccugaaguccacccaggcggccaucaaccagaucaacggcaagcugaaccggcucaucggcaagaccaacgagaaguuccaccagaucgagaaggaguucuccgagguggaggggcgcauccaggaccuggagaaguacguggaggacacgaagaucgaccuguggagcuacaacgccgagcuccuggucgcccuggagaaccagcacaccaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggacguacgaccacgacguguaccgggacgaggcccucaacaaccgcuuccagaucaagggcguggagcugaaguccggcuacaaggacuggauccuguggaucagcuucgccaucuccugcuuccuccugugcgucgcccugcucggguucaucaugugggccugccagaagggcaacauccggugcaacaucugcaucuga

SEQ ID NO: 63669 - RNA, 1701 nt, Artificial Sequence; identical to SEQ ID NO: 63605
  derived and/or modified sequence opt1 from hemagglutinin__InfluenzaA__ACP44247

SEQ ID NO: 63670 - RNA, 1701 nt, Artificial Sequence; identical to SEQ ID NO: 61638
  derived and/or modified sequence opt1 from hemagglutinin__InfluenzaA__ACP44258

SEQ ID NO: 63671 - RNA, 1701 nt, Artificial Sequence; identical to SEQ ID NO: 61638
  derived and/or modified sequence opt1 from hemagglutinin__InfluenzaA__ACP44269

SEQ ID NO: 63672 - RNA, 1701 nt, Artificial Sequence; identical to SEQ ID NO: 63664
  derived and/or modified sequence opt1 from hemagglutinin__InfluenzaA__ACQ44554

SEQ ID NO: 63673 - RNA, 1701 nt, Artificial Sequence; identical to SEQ ID NO: 63664
  derived and/or modified sequence opt1 from hemagglutinin__InfluenzaA__ACQ44556

SEQ ID NO: 63674 - RNA, 1701 nt, Artificial Sequence; identical to SEQ ID NO: 63664
  derived and/or modified sequence opt1 from hemagglutinin__InfluenzaA__ACQ45338

SEQ ID NO: 63675 - RNA, 1701 nt, Artificial Sequence
  derived and/or modified sequence opt1 from hemagglutinin__InfluenzaA__ACQ55359
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagccggagaucgccauccgccccaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacaccccggugcacgacugcaacacgaccugccagacccccaagggcgccaucaacaccucccugcccuuccagaacauccaccccaucacgaucgggaagugcccgaaguacgucaagagcaccaagcugcggcucgcgaccggccugcgcaacauccccuccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 63676 - RNA, 1701 nt, Artificial Sequence; identical to SEQ ID NO: 63664
  derived and/or modified sequence opt1 from hemagglutinin__InfluenzaA__ACQ55361

SEQ ID NO: 63677 - RNA, 1701 nt, Artificial Sequence
  derived and/or modified sequence opt1 from hemagglutinin__InfluenzaA__ACQ63223
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 63678 - RNA, 1701 nt, Artificial Sequence; identical to SEQ ID NO: 63677
  derived and/or modified sequence opt1 from hemagglutinin__InfluenzaA__ACQ63239

SEQ ID NO: 63679 - RNA, 1701 nt, Artificial Sequence; identical to SEQ ID NO: 63677
  derived and/or modified sequence opt1 from hemagglutinin__InfluenzaA__ACQ63244

SEQ ID NO: 63680 - RNA, 1701 nt, Artificial Sequence; identical to SEQ ID NO: 63677
  derived and/or modified sequence opt1 from hemagglutinin__InfluenzaA__ACQ63257

SEQ ID NO: 63681 - RNA, 1701 nt, Artificial Sequence
  derived and/or modified sequence opt1 from hemagglutinin__InfluenzaA__ACQ65691
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcuccugcaagcgcggcagcgacaacuccuucuucagccggcugaacuggcucacgcaccugaaguucaaguaccccgcccugaacgugaccaugcccaacaacgagaaguucgacaagcucuacaucuggggcguccaccaccccgggaccgacaacgaccagaucuucccguacgcccaggcguccggccgcaucaccgugagcacgaagcggagccagcagaccgugauccccaacaucgggucccgcccccggguccgcgacauccccagccggaucuccaucuacuggaccaucgugaagccgggcgacauccugcugaucaacagcaccgggaaccucaucgcgccccgcggcuacuucaagauccgguccggcaagagcuccaucaugcgcagcgacgcccccaucgggaagugcaacuccgagugcaucacgcccaacggcagcaucccgaacgacaagcccuuccagaacgugaaccggaucaccuacggggccugcccccgcuacgucaagcagaacacccugaagcuggccaccggcaugcggaacgugcccgagaagcagacgcgcgggaucuucggcgccaucgccggcuucaucgagaacgggugggagggcaugguggacgggugguacggcuuccggcaccagaacuccgaggggaucggccaggccgccgaccucaagagcacccaggccgcgaucaaccagaucaacggcaagcugaaccgccugaucgggaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagcgcaccaagaagcagcuccgggagaacgccgaggacauggggaacggcugcuucaagaucuaccacaagugcgacaacgccugcaucgggagcauccgcaacggcaccuacgaccacgacgucuaccgcgacgaggcgcugaacaaccgguuccagaucaagggcguggagcucaaguccggguacaaggacuggauccuguggaucagcuucacgaucuccugcuuccugcucugcguggcccugcugggcuucaucaugugggccugccagaaggggaacauccgcugcaacaucugcaucuga

SEQ ID NO: 63682 - RNA, 1701 nt, Artificial Sequence; identical to SEQ ID NO: 63442
  derived and/or modified sequence opt1 from hemagglutinin__InfluenzaA__ACQ65713

SEQ ID NO: 63683 - RNA, 1701 nt, Artificial Sequence
  derived and/or modified sequence opt1 from hemagglutinin__InfluenzaA__ACQ65724
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacugggccggggugacccagaacggcaccuccagcgccugcauccgccgguccaacaacagcuucuucucccgccugaacuggcucacccaccugaaguucaaguaccccgcgcugaacgugacgaugcccaacaacgagcaguucgacaagcucuacaucuggggcguccaccaccccgggaccgacaacgaccagaucuuccuguacgcccaggccagcgggcggaucaccguguccaccaagcgcagccagcagacggugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 63684 - RNA, 1701 nt, Artificial Sequence
  derived and/or modified sequence opt1 from hemagglutinin__InfluenzaA__ACQ65747
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccggacgaacaacuccuucuucagccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcgcaggccuccgggcggaucacggugagcaccaagcgcucccagcagaccgugaucccgaacaucggcagccggccccgcguccggaacauccccagccgcaucuccaucuacuggaccaucgugaagcccggcgacauccugcucaucaacagcacggggaaccugaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugauggacgggugguacggcuuccgccaccagaacuccgaggggaucggccaggccgccgaccucaagagcacccaggcggccaucgaccagaucaacgggaagcugaacggccugaucggcaagaccaacgagaaguuccaccagaucgagaaggaguucuccgagguggaggggcggauccaggaccuggagaaguacgucgaggacacgaagaucgaccuguggagcuacaacgccgagcuccugguggcccuggagaaccagcacaccaucgaccucaccgacuccgagaugaacaagcuguucgagaagaccaagaagcagcugcgcgagaacgccgaggacaugggcaacgggugcuucaagaucuaccacaagugcgacaacgcgugcaucggcagcauccggaacgggacguacgaccacgacguguaccgcgacgaggcccucaacaaccgcuuccagaucaagggcgucgagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 63685 - RNA, 1698 nt, Artificial Sequence
  derived and/or modified sequence opt1 from hemagglutinin__InfluenzaA__ACQ65758
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacgugguggagaagcccaaccccgagaacgggaccugcuaccccggccacuucgccgacuacgaggagcugcgcgagcagcucuccagcgucuccagcuucgagcgguucgagaucuucccgaaggaguccagcuggcccaaccacacggugaccgggguguccgccagcugcucccacaacggcgagagcuccuucuaccgcaaccugcuguggcucaccgggaagaacggccuguaccccaaccugagcaaguccuacgccaacaacaaggggaaggagguccucgugcuguggggcgugcaccacccgcccaacaucggcgaccagaacacccuguaccacacggagaacgccuacgucagcguggugagcucccacuacagccggaaguucacccccgagaucgccaagcgccccaagguccgggaccaggaggggcgcaucaacuacuacuggacccuccuggagcccggcgacaccaucaucuucgaggccaacgggaaccugaucgcgccgcgguacgccuucgcccucucccgcggcuucggcagcgggaucaucaacuccaacgcccccauggacaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagagccgcgggcuguucggcgccaucgccggcuucaucgagggcggcuggaccgggaugguggacggcugguacggguaccaccaccagaacgagcagggcuccggcuacgccgcggaccagaaguccacgcagaacgccaucaacgggaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgucaagcucgaguccauggggguguaccagauccuggcgaucuacagcaccguggccagcucccugguccuccuggugagccugggcgccaucuccuucuggaugugcagcaacgggucccuccagugccggaucugcaucuga

SEQ ID NO: 63686 - RNA, 1701 nt, Artificial Sequence; identical to SEQ ID NO: 63664
  derived and/or modified sequence opt1 from hemagglutinin__InfluenzaA__ACQ73386

SEQ ID NO: 63687 - RNA, 1701 nt, Artificial Sequence; identical to SEQ ID NO: 63677
  derived and/or modified sequence opt1 from hemagglutinin__InfluenzaA__ACQ73387

SEQ ID NO: 63688 - RNA, 1701 nt, Artificial Sequence
  derived and/or modified sequence opt1 from hemagglutinin__InfluenzaA__ACQ73555
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaagcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 63689 - RNA, 1701 nt, Artificial Sequence; identical to SEQ ID NO: 63677
  derived and/or modified sequence opt1 from hemagglutinin__InfluenzaA__ACQ76294

SEQ ID NO: 63690 - RNA, 1701 nt, Artificial Sequence; identical to SEQ ID NO: 63677
  derived and/or modified sequence opt1 from hemagglutinin__InfluenzaA__ACQ76314

SEQ ID NO: 63691 - RNA, 1701 nt, Artificial Sequence; identical to SEQ ID NO: 63677
  derived and/or modified sequence opt1 from hemagglutinin__InfluenzaA__ACQ76317

SEQ ID NO: 63692 - RNA, 1701 nt, Artificial Sequence
  derived and/or modified sequence opt1 from hemagglutinin__InfluenzaA__ACQ76318
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacacguacguguucgugggcagcucccgguacagcaagaaguucaagccggagaucgccauccgccccaagguccgggaccaggagggccgcaugaacuacuacuggacccugguggagcccggggacaagaucaccuucgaggccaccggcaaccucguggucccccgguacgcguucgccauggagcgcaacgccggguccggcaucaucaucagcgacacgccggugcacgacugcaacacgaccugccagacccccaagggcgccaucaacaccucccugcccuuccagaacauccaccccaucaccaucgggaagugcccgaaguacgucaagagcaccaagcugcggcucgccaccggccugcgcaacauccccuccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggugaacuccgugaucgagaagaugaacacccaguucacggcggucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 63693 - RNA, 1701 nt, Artificial Sequence; identical to SEQ ID NO: 63664
  derived and/or modified sequence opt1 from hemagglutinin__InfluenzaA__ACQ76326

SEQ ID NO: 63694 - RNA, 1701 nt, Artificial Sequence; identical to SEQ ID NO: 63664
  derived and/or modified sequence opt1 from hemagglutinin__InfluenzaA__ACQ76336

SEQ ID NO: 63695 - RNA, 1701 nt, Artificial Sequence; identical to SEQ ID NO: 63664
  derived and/or modified sequence opt1 from hemagglutinin__InfluenzaA__ACQ76347

SEQ ID NO: 63696 - RNA, 1701 nt, Artificial Sequence; identical to SEQ ID NO: 63677
  derived and/or modified sequence opt1 from hemagglutinin__InfluenzaA__ACQ76365

SEQ ID NO: 63697 - RNA, 1701 nt, Artificial Sequence; identical to SEQ ID NO: 63677
  derived and/or modified sequence opt1 from hemagglutinin__InfluenzaA__ACQ76370

SEQ ID NO: 63698 - RNA, 1701 nt, Artificial Sequence; identical to SEQ ID NO: 63664
  derived and/or modified sequence opt1 from hemagglutinin__InfluenzaA__ACQ76376

SEQ ID NO: 63699 - RNA, 1701 nt, Artificial Sequence
  derived and/or modified sequence opt1 from hemagglutinin__InfluenzaA__ACQ76383
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaaggggaucaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggagcggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 63700 - RNA, 1701 nt, Artificial Sequence; identical to SEQ ID NO: 63677
  derived and/or modified sequence opt1 from hemagglutinin__InfluenzaA__ACQ76389

SEQ ID NO: 63701 - RNA, 1701 nt, Artificial Sequence; identical to SEQ ID NO: 63664
  derived and/or modified sequence opt1 from hemagglutinin__InfluenzaA__ACQ76401

SEQ ID NO: 63702 - RNA, 1701 nt, Artificial Sequence; identical to SEQ ID NO: 63677
  derived and/or modified sequence opt1 from hemagglutinin__InfluenzaA__ACQ76405

SEQ ID NO: 63703 - RNA, 1701 nt, Artificial Sequence
  derived and/or modified sequence opt1 from hemagglutinin__InfluenzaA__ACQ76408
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 63704 - RNA, 1701 nt, Artificial Sequence
  derived and/or modified sequence opt1 from hemagglutinin__InfluenzaA__ACQ77601
augaagaccaucaucgcccugagcuacauccucugccuggccuucgcgcagaagcugcccggcaacgacaacuccaccgccacgcucugccuggggcaccacgccgugccgaacggcacccuggucaagaccaucaccaacgaccagaucgaggugacgaacgccaccgagcucgugcagagcuccagcaccgggcgcaucugcgacagcccccaccagauccuggacggcgagaacugcacccugaucgacgcccuccugggggacccccacugcgacggcuuccagaacaaggagugggaccuguucgucgagcgguccaaggcguacuccgacugcuaccccuacgacgugccggacuacgccagccuccgcucccugguggccagcuccggcacgcuggaguucaacaacgagagcuucaacuggaccggggucgcccagaacggcaccuccagcgcgugcaagcggcgcuccaucaagagcuucuucucccggcucaacuggcugcaccagcuggagaaccgcuaccccgcccccaacgugaccaugcccaacaacgacaaguucgacaagcucuacaucuggggcgugcaccacccgagcacggacuccgaccagaucagcgucuacgcccaggccagcgggcgggugaccguguccaccaagcgcagccagcagaccgucauccccaacaucgggucccggcccugggugcgcggcaucagcucccggaucagcaucuacuggacgaucgugaagcccggcgacauccugcugaucaacuccaccgggaaccucaucgccccgcgcggcuacuucaagauccggagcgggaaguccagcaucaugcgcuccgacgcgcccaucggcaagugcaacagcgagugcaucacccccaacggcuccauccccaacgacaagccguuccagaacgucaaccggaucaccuacggggccugcccccgcuacgugaagcagaacacgcugaagcuggccaccggcaugcggaacgugcccgagaagcagacccgcgggaucuucggcgccaucgccggguucaucgagaacggcugggagggcaugauggacgggugguacggcuuccggcaccagaacagcgaggggaccggccaggcggccgaccucaaguccacgcaggccgccaucaaccagaucaacgggaagcugaacaagcugaucgagaagaccaacgagaaguuccaccagaucgagaaggaguucagcgaggucgagggccgcauccaggaccucgagaaguacguggaggacaccaagaucgaccugugguccuacaacgccgagcugcucguggcgcuggagaaccagcacaccaucgaccugacggacagcgagaugaacaagcuguucgagcggacccgcaagcagcuccgcgagaacgccgaggacaugggcaacgggugcuucaagaucuaccacaagugcgacaacgccugcaucggcuccauccggaacgggaccuacgaccacgacgucuaccgcgacgaggcccugaacaaccgguuccagaucaagggcguggagcucaagagcggguacaaggacuggauccuguggaucagcuucgccaucuccugcuuccugcucugcgugguccugcugggcuucaucaugugggcgugccagaagggcaacauccgcugcaacaucugcaucuga

SEQ ID NO: 63705 - RNA, 1701 nt, Artificial Sequence
  derived and/or modified sequence opt1 from hemagglutinin__InfluenzaA__ACQ83310
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccaugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcuccagccgguacuccaagaagcugaagcccgagaucgccauccgcccgaaggugcgggaccaggagggccgcaugaacuacuacuggacgcucgucgagcccggggacaagaucaccuucgaggcgaccggcaaccugguggugccccgguacgccuucgccauggagcgcaacgccgggagcggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcuccggcuggcgaccggccugcgcaacgugccgagcauccagucccggggccucuucggggccaucgccggguucaucgagggcggcuggaccgggauggucgacggcugguacggguaccaccaccagaacgagcagggcagcggguacgccgccgaccugaaguccacgcagaacgcgaucgacgagaucaccaacaaggugaacagcgugaucgagaagaugaacacccaguucaccgccgucggcaaggaguucaaccaccuggagaagcgcaucgagaaccucaacaagaagguggacgacggcuuccuggacaucuggacguacaacgccgagcugcucguccugcuggagaacgagcggacccucgacuaccacgacuccaacgugaagaaccuguacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcucaaccgggaggagaucgacggcgugaagcuggaguccacccgcaucuaccagauccuggcgaucuacagcaccguggccagcucccucguccugguggugagccugggggccaucuccuucuggaugugcagcaacggcucccuccagugccggaucugcaucuga

SEQ ID NO: 63706 - RNA, 1701 nt, Artificial Sequence; identical to SEQ ID NO: 63664
  derived and/or modified sequence opt1 from hemagglutinin__InfluenzaA__ACQ84451

SEQ ID NO: 63707 - RNA, 1701 nt, Artificial Sequence; identical to SEQ ID NO: 63664
  derived and/or modified sequence opt1 from hemagglutinin__InfluenzaA__ACQ84457

SEQ ID NO: 63708 - RNA, 1701 nt, Artificial Sequence
  derived and/or modified sequence opt1 from hemagglutinin__InfluenzaA__ACQ84477
augaaggccauccugcucgugcugcuguacaccuucaccgccgcgaacgccgacacgcucugcaucggcuaccacgccaacaacagcaccgacaccgucgacaccgugcuggagaagaacgugacggucacccacuccgugaaccugcucgaggaccgccacaacgggaagcugugcaagcugcggggcguggcgccccuccaccuggggaagugcaacaucgccggcuggcugcucgggaacccggagugcgagcugcuguucaccgccagcuccuggagcuacaucgucgagaccuccaacagcgacaacggcacgugcuaccccggcgacuucaucaacuacgaggagcuccgcgagcagcuguccagcguguccagcuucgagcgguucgagaucuuccccaaggccuccagcuggcccgaccacgagaccaaccgcggggugaccgccgccugcccguacgcgggcgccaacuccuucuaccggaaccugaucuggcucgucaagaaggggaacagcuaccccaagcuguccaagagcuacgugaacaacaaggagaaggaggugcugguccucuggggcauccaccacccgcccaccuccacggaccagcagagccuguaccagaacgccgacgccuacguguucgugggguccagcaaguacaacaagaaguucaagcccgagaucgccacccgccccaagguccggggccaggcgggccgcaugaacuacuacuggacccugguggagcccggggacaccaucacguucgaggccaccggcaaccucguggucccccgguacgccuucgccaugaagcgcgggagcggcuccggcaucaucaucagcgacaccccggugcacgacugcaacaccacgugccagacccccaagggggccaucaacaccucccugcccuuccagaacauccaccccgugaccaucggcgagugcccgaaguacgucaagagcacgaagcugcggauggcgaccgggcuccgcaacauccccuccauccagagccggggccuguucggggccaucgccggcuucaucgagggcggguggaccggcaugaucgacgggugguacggcuaccaccaccagaacgagcagggguccggcuacgccgccgaccagaaguccacccagaacgcgaucgacggcaucacgaacaaggugaacagcgugaucgagaagaugaacacccaguucaccgccgucgggaaggaguucaaccaccuggagaagcgcaucgagaaccucaacaagaagguggacgacggcuuccuggacgucuggaccuacaacgccgagcugcucgugcugcuggagaacgagcggacgcucgacuaccacgacagcaacgugaagaaccuguacgagaagguccgcucccagcugaagaacaacgccaaggagaucgggaacggcugcuucgaguucuaccacaagugcgacgacacgugcauggagagcgugaagaacgggaccuacgacuaccccaaguacuccgaggagagcaagcucaaccgggaggagaucgacggcgugaagcuggaguccacccgcaucuaccagauccuggccaucuacagcaccgucgcguccagccucgugcugcuggugucccucggcgccaucagcuucuggaugugcagcaacgggucccugcagugccggaucugcaucuga

SEQ ID NO: 63709 - RNA, 1701 nt, Artificial Sequence
  derived and/or modified sequence opt1 from hemagglutinin__InfluenzaA__ACQ89900
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucguggagaagaugaacacccaguucaccgccgucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccagcucccuggugcucgucgugagccugggggccaucuccuucuggaugugcagcaacggcucccugcagugccggaucugcaucuga

SEQ ID NO: 63710 - RNA, 1701 nt, Artificial Sequence; identical to SEQ ID NO: 63677
  derived and/or modified sequence opt1 from hemagglutinin__InfluenzaA__ACQ89902

SEQ ID NO: 63711 - RNA, 1701 nt, Artificial Sequence
  derived and/or modified sequence opt1 from hemagglutinin__InfluenzaA__ACQ89904
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaagggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 63712 - RNA, 1701 nt, Artificial Sequence; identical to SEQ ID NO: 63709
  derived and/or modified sequence opt1 from hemagglutinin__InfluenzaA__ACQ89905

SEQ ID NO: 63713 - RNA, 1701 nt, Artificial Sequence; identical to SEQ ID NO: 63664
  derived and/or modified sequence opt1 from hemagglutinin__InfluenzaA__ACQ99607

SEQ ID NO: 63714 - RNA, 1701 nt, Artificial Sequence; identical to SEQ ID NO: 63664
  derived and/or modified sequence opt1 from hemagglutinin__InfluenzaA__ACQ99608

SEQ ID NO: 63715 - RNA, 1701 nt, Artificial Sequence; identical to SEQ ID NO: 63664
  derived and/or modified sequence opt1 from hemagglutinin__InfluenzaA__ACQ99609

SEQ ID NO: 63716 - RNA, 1701 nt, Artificial Sequence; identical to SEQ ID NO: 63664
  derived and/or modified sequence opt1 from hemagglutinin__InfluenzaA__ACQ99611

SEQ ID NO: 63717 - RNA, 1701 nt, Artificial Sequence
  derived and/or modified sequence opt1 from hemagglutinin__InfluenzaA__ACQ99614
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcugauccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 63718 - RNA, 1701 nt, Artificial Sequence; identical to SEQ ID NO: 63717
  derived and/or modified sequence opt1 from hemagglutinin__InfluenzaA__ACQ99616

SEQ ID NO: 63719 - RNA, 1701 nt, Artificial Sequence; identical to SEQ ID NO: 63664
  derived and/or modified sequence opt1 from hemagglutinin__InfluenzaA__ACQ99617

SEQ ID NO: 63720 - RNA, 1701 nt, Artificial Sequence; identical to SEQ ID NO: 63664
  derived and/or modified sequence opt1 from hemagglutinin__InfluenzaA__ACQ99618

SEQ ID NO: 63721 - RNA, 1701 nt, Artificial Sequence; identical to SEQ ID NO: 63664
  derived and/or modified sequence opt1 from hemagglutinin__InfluenzaA__ACQ99619

SEQ ID NO: 63722 - RNA, 1701 nt, Artificial Sequence; identical to SEQ ID NO: 63664
  derived and/or modified sequence opt1 from hemagglutinin__InfluenzaA__ACQ99620

SEQ ID NO: 63723 - RNA, 1701 nt, Artificial Sequence; identical to SEQ ID NO: 63717
  derived and/or modified sequence opt1 from hemagglutinin__InfluenzaA__ACQ99621

SEQ ID NO: 63724 - RNA, 1701 nt, Artificial Sequence; identical to SEQ ID NO: 63664
  derived and/or modified sequence opt1 from hemagglutinin__InfluenzaA__ACQ99622

SEQ ID NO: 63725 - RNA, 1701 nt, Artificial Sequence
  derived and/or modified sequence opt1 from hemagglutinin__InfluenzaA__ACR01014
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcauggagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 63726 - RNA, 1701 nt, Artificial Sequence; identical to SEQ ID NO: 63677
  derived and/or modified sequence opt1 from hemagglutinin__InfluenzaA__ACR08419

SEQ ID NO: 63727 - RNA, 1701 nt, Artificial Sequence
  derived and/or modified sequence opt1 from hemagglutinin__InfluenzaA__ACR08429
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacacgggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 63728 - RNA, 1701 nt, Artificial Sequence; identical to SEQ ID NO: 63677
  derived and/or modified sequence opt1 from hemagglutinin__InfluenzaA__ACR08439

SEQ ID NO: 63729 - RNA, 1701 nt, Artificial Sequence; identical to SEQ ID NO: 63677
  derived and/or modified sequence opt1 from hemagglutinin__InfluenzaA__ACR08449

SEQ ID NO: 63730 - RNA, 1701 nt, Artificial Sequence
  derived and/or modified sequence opt1 from hemagglutinin__InfluenzaA__ACR08459
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcgacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 63731 - RNA, 1701 nt, Artificial Sequence; identical to SEQ ID NO: 63664
  derived and/or modified sequence opt1 from hemagglutinin__InfluenzaA__ACR08528

SEQ ID NO: 63732 - RNA, 1701 nt, Artificial Sequence; identical to SEQ ID NO: 63664
  derived and/or modified sequence opt1 from hemagglutinin__InfluenzaA__ACR08530

SEQ ID NO: 63733 - RNA, 1701 nt, Artificial Sequence; identical to SEQ ID NO: 63730
  derived and/or modified sequence opt1 from hemagglutinin__InfluenzaA__ACR08531

SEQ ID NO: 63734 - RNA, 1701 nt, Artificial Sequence; identical to SEQ ID NO: 63677
  derived and/or modified sequence opt1 from hemagglutinin__InfluenzaA__ACR08533

SEQ ID NO: 63735 - RNA, 1701 nt, Artificial Sequence; identical to SEQ ID NO: 63730
  derived and/or modified sequence opt1 from hemagglutinin__InfluenzaA__ACR08535

SEQ ID NO: 63736 - RNA, 1701 nt, Artificial Sequence; identical to SEQ ID NO: 63677
  derived and/or modified sequence opt1 from hemagglutinin__InfluenzaA__ACR08536

SEQ ID NO: 63737 - RNA, 1701 nt, Artificial Sequence; identical to SEQ ID NO: 63730
  derived and/or modified sequence opt1 from hemagglutinin__InfluenzaA__ACR08537

SEQ ID NO: 63738 - RNA, 1701 nt, Artificial Sequence; identical to SEQ ID NO: 63730
  derived and/or modified sequence opt1 from hemagglutinin__InfluenzaA__ACR08538

SEQ ID NO: 63739 - RNA, 1701 nt, Artificial Sequence; identical to SEQ ID NO: 63677
  derived and/or modified sequence opt1 from hemagglutinin__InfluenzaA__ACR08539

SEQ ID NO: 63740 - RNA, 1701 nt, Artificial Sequence; identical to SEQ ID NO: 63677
  derived and/or modified sequence opt1 from hemagglutinin__InfluenzaA__ACR08540

SEQ ID NO: 63741 - RNA, 1701 nt, Artificial Sequence; identical to SEQ ID NO: 63664
  derived and/or modified sequence opt1 from hemagglutinin__InfluenzaA__ACR08542

SEQ ID NO: 63742 - RNA, 1701 nt, Artificial Sequence; identical to SEQ ID NO: 63664
  derived and/or modified sequence opt1 from hemagglutinin__InfluenzaA__ACR08543

SEQ ID NO: 63743 - RNA, 1701 nt, Artificial Sequence; identical to SEQ ID NO: 63703
  derived and/or modified sequence opt1 from hemagglutinin__InfluenzaA__ACR08544

SEQ ID NO: 63744 - RNA, 1701 nt, Artificial Sequence; identical to SEQ ID NO: 63730
  derived and/or modified sequence opt1 from hemagglutinin__InfluenzaA__ACR08545

SEQ ID NO: 63745 - RNA, 1701 nt, Artificial Sequence; identical to SEQ ID NO: 63664
  derived and/or modified sequence opt1 from hemagglutinin__InfluenzaA__ACR08546

SEQ ID NO: 63746 - RNA, 1701 nt, Artificial Sequence; identical to SEQ ID NO: 63677
  derived and/or modified sequence opt1 from hemagglutinin__InfluenzaA__ACR08547

SEQ ID NO: 63747 - RNA, 1701 nt, Artificial Sequence; identical to SEQ ID NO: 63730
  derived and/or modified sequence opt1 from hemagglutinin__InfluenzaA__ACR08548

SEQ ID NO: 63748 - RNA, 1701 nt, Artificial Sequence; identical to SEQ ID NO: 63677
  derived and/or modified sequence opt1 from hemagglutinin__InfluenzaA__ACR08549

SEQ ID NO: 63749 - RNA, 1701 nt, Artificial Sequence; identical to SEQ ID NO: 63677
  derived and/or modified sequence opt1 from hemagglutinin__InfluenzaA__ACR08550

SEQ ID NO: 63750 - RNA, 1701 nt, Artificial Sequence; identical to SEQ ID NO: 63677
  derived and/or modified sequence opt1 from hemagglutinin__InfluenzaA__ACR08551

SEQ ID NO: 63751 - RNA, 1701 nt, Artificial Sequence; identical to SEQ ID NO: 63664
  derived and/or modified sequence opt1 from hemagglutinin__InfluenzaA__ACR08552

SEQ ID NO: 63752 - RNA, 1701 nt, Artificial Sequence; identical to SEQ ID NO: 63703
  derived and/or modified sequence opt1 from hemagglutinin__InfluenzaA__ACR08553

SEQ ID NO: 63753 - RNA, 1701 nt, Artificial Sequence; identical to SEQ ID NO: 63703
  derived and/or modified sequence opt1 from hemagglutinin__InfluenzaA__ACR08554

SEQ ID NO: 63754 - RNA, 1701 nt, Artificial Sequence; identical to SEQ ID NO: 63664
  derived and/or modified sequence opt1 from hemagglutinin__InfluenzaA__ACR09365

SEQ ID NO: 63755 - RNA, 1701 nt, Artificial Sequence; identical to SEQ ID NO: 63664
  derived and/or modified sequence opt1 from hemagglutinin__InfluenzaA__ACR09366

SEQ ID NO: 63756 - RNA, 1701 nt, Artificial Sequence; identical to SEQ ID NO: 63664
  derived and/or modified sequence opt1 from hemagglutinin__InfluenzaA__ACR09367

SEQ ID NO: 63757 - RNA, 1701 nt, Artificial Sequence; identical to SEQ ID NO: 63664
  derived and/or modified sequence opt1 from hemagglutinin__InfluenzaA__ACR09368

SEQ ID NO: 63758 - RNA, 1701 nt, Artificial Sequence; identical to SEQ ID NO: 63664
  derived and/or modified sequence opt1 from hemagglutinin__InfluenzaA__ACR09369

SEQ ID NO: 63759 - RNA, 1701 nt, Artificial Sequence; identical to SEQ ID NO: 63664
  derived and/or modified sequence opt1 from hemagglutinin__InfluenzaA__ACR09370

SEQ ID NO: 63760 - RNA, 1701 nt, Artificial Sequence; identical to SEQ ID NO: 63664
  derived and/or modified sequence opt1 from hemagglutinin__InfluenzaA__ACR09371

SEQ ID NO: 63761 - RNA, 1701 nt, Artificial Sequence; identical to SEQ ID NO: 63664
  derived and/or modified sequence opt1 from hemagglutinin__InfluenzaA__ACR09373

SEQ ID NO: 63762 - RNA, 1701 nt, Artificial Sequence; identical to SEQ ID NO: 63664
  derived and/or modified sequence opt1 from hemagglutinin__InfluenzaA__ACR09374

SEQ ID NO: 63763 - RNA, 1701 nt, Artificial Sequence
  derived and/or modified sequence opt1 from hemagglutinin__InfluenzaA__ACR09375
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagaagaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 63764 - RNA, 1701 nt, Artificial Sequence; identical to SEQ ID NO: 63664
  derived and/or modified sequence opt1 from hemagglutinin__InfluenzaA__ACR09376

SEQ ID NO: 63765 - RNA, 1701 nt, Artificial Sequence; identical to SEQ ID NO: 63664
  derived and/or modified sequence opt1 from hemagglutinin__InfluenzaA__ACR09377

SEQ ID NO: 63766 - RNA, 1701 nt, Artificial Sequence; identical to SEQ ID NO: 63664
  derived and/or modified sequence opt1 from hemagglutinin__InfluenzaA__ACR09395

SEQ ID NO: 63767 - RNA, 1701 nt, Artificial Sequence; identical to SEQ ID NO: 63664
  derived and/or modified sequence opt1 from hemagglutinin__InfluenzaA__ACR09396

SEQ ID NO: 63768 - RNA, 1701 nt, Artificial Sequence
  derived and/or modified sequence opt1 from hemagglutinin__InfluenzaA__ACR10186
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 63769 - RNA, 1701 nt, Artificial Sequence; identical to SEQ ID NO: 63768
  derived and/or modified sequence opt1 from hemagglutinin__InfluenzaA__ACR10222

SEQ ID NO: 63770 - RNA, 1701 nt, Artificial Sequence
  derived and/or modified sequence opt1 from hemagglutinin__InfluenzaA__ACR10223
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 63771 - RNA, 1701 nt, Artificial Sequence
  derived and/or modified sequence opt1 from hemagglutinin__InfluenzaA__ACR15183
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgcggcuccgacaacagcuucuucucccggcugaacuggcucacgcaccugaaguucaaguaccccgcccugaacgugaccaugcccaacaacgagaaguucgacaagcucuacaucuggggcguccaccaccccgggaccgacaacgaccagaucuucccguacgcgcaggccagcggccgcaucaccguguccacgaagcggagccagcagaccgugauccccaacaucgggagccgcccccggguccgcaacauccccucccggaucagcaucuacuggaccaucgugaagccgggcgacauccugcugaucaacuccaccgggaaccucaucgcgccccgcggcuacuucaagauccggagcggcaaguccagcaucaugcgcuccgacgcccccaucgggaagugcaacagcgagugcaucacgcccaacggcuccaucccgaacgacaagcccuuccagaacgugaaccggaucaccuacggggccugcccccgcuacgucaagcagaacacccugaagcuggccaccggcaugcggaacgugcccgagaagcagacgcgcgggaucuucggcgccaucgccggcuucaucgagaacgggugggagggcaugguggacgggugguacggcuuccggcaccagaacagcgaggggaucggccaggccgccgaccucaaguccacccaggcggccaucaaccagaucaacggcaagcugaaccgccugaucgggaagaccaacgagaaguuccaccagaucgagaaggaguucagcgaggucgagggccggauccaggaccucgagaaguacguggaggacaccaagaucgaccugugguccuacaacgccgagcugcucguggcccuggagaaccagcacacgaucgaccugaccgacagcgagaugaacaagcuguucgagcgcaccaagaagcagcuccgggagaacgccgaggacauggggaacggcugcuucaagaucuaccacaagugcgacaacgcgugcaucggguccauccgcaacggcaccuacgaccacgacgucuaccgcgacgaggcccugaacaaccgguuccagaucaagggcguggagcucaagagcggguacaaggacuggauccuguggaucuccuucgccaucagcugcuuccugcucugcguggcccugcugggcuucaucaugugggccugccagaaggggaacauccgcugcaacaucugcaucuga

SEQ ID NO: 63772 - RNA, 1698 nt, Artificial Sequence
  derived and/or modified sequence opt1 from hemagglutinin__InfluenzaA__ACR15194
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcaaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcgggcugggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcuccgcauggucaccgggcugcggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcucgagcggcgcauggagaaccugaacaagaaggucgacgacggcuucaucgacaucuggaccuacaacgccgagcugcucgugcugcuggagaacgagcggacgcucgacuuccacgacagcaacgugaagaaccuguacgagaaggucaagucccagcugaagaacaacgcgaaggagaucgggaaccgcugcuucgaguucuaccacaagugcaacgacgagugcauggagagcgugaagaacggcaccuacgacuaccccaaguacuccgaggagagcaagcucaaccgggagaagaucgacggggugaagcuggaguccaugggcgucuaccagauccuggccaucuacagcaccguggccagcucccucgugcugcuggucagccucggcgccaucuccuucuggaugugcagcaacgggucccugcagugccgcaucugcaucuga

SEQ ID NO: 63773 - RNA, 1698 nt, Artificial Sequence; identical to SEQ ID NO: 61878
  derived and/or modified sequence opt1 from hemagglutinin__InfluenzaA__ACR15216

SEQ ID NO: 63774 - RNA, 1701 nt, Artificial Sequence
  derived and/or modified sequence opt1 from hemagglutinin__InfluenzaA__ACR15227
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugccagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcagaccuccggccggaucacggugagcaccaagcgcagccagcagaccgugaucccgaacaucggcucccggccccgcguccgggacgugcccagccgcaucuccaucuacuggaccaucgugaagcccggggacauccugcucaucaacagcacgggcaaccugaucgccccgcggggguacuucaagauccgcuccggcaagagcuccaucaugcggagcgacgcccccaucggcaagugcaacuccgagugcaucacccccaacgggagcauccccaacgacaagccguuccagaacgucaaccgcaucaccuacggcgccugcccccgguacgugaagcagaacacccugaagcucgccacggggaugcgcaacgugcccgagcggcagacccgcggcaucuucggggcgaucgccggcuucaucgagaacggcugggaggggaugauggacggcugguacggguuccggcaccagaacuccgagggcaccgggcaggccgccgaccugaaguccacccaggccgcgaucaaccagaucaacggcaagcugaaccgccucaucggcaagacgaacgagaaguuccaccagaucgagaaggaguucuccgaggucgaggggcggauccaggaccuggagaaguacguggaggacaccaagaucgaccuguggagcuacaacgccgagcuccugguggcccuggagaaccagcacaccaucgaccucaccgacuccgagaugaacaagcuguucgagcgcacgaagaagcagcugcgcgagaacgccgaggacaugggcaacgggugcuucaagaucuaccacaagugcgacaacgccugcaucggcagcauccggaacgggaccuacgaccacgacgucuaccgcgacgaggcgcucaacaaccgguuccagaucaagggcguggagcugaaguccggcuacaaggacuggauccuguggaucagcuucgccaucuccugcuuccuccugugcguggcccugcucggguucaucaugugggccugccagaagggcaacauccgcugcaacaucugcaucuga

SEQ ID NO: 63775 - RNA, 1698 nt, Artificial Sequence
  derived and/or modified sequence opt1 from hemagglutinin__InfluenzaA__ACR15238
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgugcagaaggcccuguaccacaccgagaacgccuacgucagcguggugagcucccacuacagccggaaguucacgcccgagaucgccaagcgccccaagguccgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacgugcacccggugaccaucggcgagugccccaaguacguccggagcgccaagcugcgcauggugaccgggcuccggaacauccccuccauccagagccgcggccuguucggggccaucgccggcuucaucgagggcggguggaccggcaugguggacgggugguacggcuaccagcaccagaacgagcagggguccggcuacgcggccgaccagaaguccacccagaacgccaucaacggcaucacgaacaaggucaacagcgugaucgagaagaugaacacccaguucaccgccgucgggaaggaguucaacaagcuggagcggcgcauggagaaccucaacaagaagguggacgacggcuucaucgacaucuggaccuacaacgccgagcugcuggugcuccuggagaacgagcggacgcuggacuuccacgacagcaacgucaagaaccucuacgagaaggugaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgucaagcucgaguccaugggcguguaccagauccuggccaucuacagcaccguggccagcucccugguccuccuggugagccugggggccaucuccuucuggaugugcagcaacggcucccuccagugccggaucugcaucuga

SEQ ID NO: 63776 - RNA, 1701 nt, Artificial Sequence
  derived and/or modified sequence opt1 from hemagglutinin__InfluenzaA__ACR15249
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcacagcaaguucaaguaccccgcccugaacgugaccaugcccaacaacgagaaguucgacaagcuguacaucuggggcguccaccaccccgggaccgacaacgaccagaucuuccucuacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcugaucaacagcaccgggaaccucaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 63777 - RNA, 1701 nt, Artificial Sequence
  derived and/or modified sequence opt1 from hemagglutinin__InfluenzaA__ACR15282
augaagaccaucaucgcccugagcuacauccucugccugguguucgcccagaagcugcccggcaacgacaacuccaccgcgacgcucugccuggggcaccacgccgucccgaacggcaccaucgugaagaccaucaugaacgaccagaucgaggugaccaacgccacggagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggacgggggugacccagaacggcaccuccagcgccugcauccgccgguccaacaacagcuucuucucccgccugaacuggcucacccacagcaaguucaaguaccccgcccugaacgugacgaugcccaacaacgagaaguucgacaagcuguacaucuggggcguccaccaccccgggaccgacaacgaccagaucuuccucuacgcgcaggccuccgggcggaucaccgugagcaccaagcgcagccagcagacggugaucccgaacaucggcucccggccccgcguccggaacauccccagccgcaucuccaucuacuggaccaucgugaagcccggcgacauccugcugaucaacagcaccgggaaccucaucgccccgcggggcuacuucaagauccgcuccgggaaguccuccaucaugcggagcgacgcccccaucggcaagugcaacuccgagugcaucacccccaacggcagcauccccaacgacaagccguuccagaacgugaaccgcaucacguacggggccugcccccgguacgucaagcagaacacccugaagcuggcgaccggcaugcgcaacgugcccgagaagcagacccgggggaucuucggcgccaucgccggguucaucgagaacggcugggagggcaugguggacgggugguacggcuuccgccaccagaacuccgaggggaucggccaggccgccgaccucaagagcacgcaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacaccaucgaccugacggacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 63778 - RNA, 1701 nt, Artificial Sequence
  derived and/or modified sequence opt1 from hemagglutinin__InfluenzaA__ACR15293
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucaucgccagcuccgggacgcuggaguucaacaacgagaacuucaacuggaccggcgucacccagaacgggaccagcuccgccugcaagcgcggcagcgacaacuccuucuucagccggcugaacuggcucacgcaccugaaguucaaguaccccgcccugaaggugaccaugcccaacaacgagaaguucgacaagcucuacaucuggggcgugcaccaccccgggaccgacaacgaccagaucuuccuguacgcgcaggccuccggccgcaucaccgucagcacgaagcggucccagcagaccgugaucccgaacaucgggagccgcccccgggugcgcaacauccccagccggaucuccaucuacuggaccaucgucaagcccggcgacauccugcucaucaacagcaccgggaaccugaucgccccgcgcggcuacuucaagauccgguccggcaagagcuccaucaugcgcagcgacgcccccaucgggaagugcaacuccgagugcaucacgcccaacggcagcauccccaacgacaagccguuccagaacgugaaccggaucaccuacggggccugcccccgcuacgugaagcagaacacccugaagcucgcgaccggcaugcggaacguccccgagaagcagacgcgcgggaucuucggcgccaucgccggcuucaucgagaacgggugggagggcaugguggacgggugguacggcuuccggcaccagaacuccgaggggaucggccaggccgccgaccugaaguccacccaggcggccaucaaccagaucaacggcaagcugaaccgccucaucgggaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagcgcaccaagaagcagcugcgggagaacgccgaggacauggggaacggcugcuucaagaucuaccacaagugcgacaacgcgugcaucgggagcauccgcaacggcaccuacgaccacgacguguaccgcgacgaggcccucaacaaccgguuccagaucaagggcgucgagcugaaguccggguacaaggacuggauccuguggaucagcuucgccaucuccugcuuccuccugugcguggcccugcucggcuucaucaugugggccugccagaaggggaacauccgcugcaacaucugcaucuga

SEQ ID NO: 63779 - RNA, 1698 nt, Artificial Sequence
  derived and/or modified sequence opt1 from hemagglutinin__InfluenzaA__ACR15304
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaaggaguccagcuggcccaaccacaccgugaccggggucuccgccagcugcucccacaacggcaagagcuccuucuaccgcaaccugcuguggcucaccgggaagaacggccuguaccccaaccugagcaaguccuacgccaacaacaaggagaaggaggugcucgugcuguggggcguccaccacccgcccaacacggggaaccagcgggcccuguaccacaccgagaacgccuacgugagcguggucagcucccacuacagccgccgguucacccccgagaucgcgaagcgccccaaggugcgggaccaggagggccgcaucaacuacuacuggacccuccuggagcccggggacacgaucaucuucgaggccaacggcaaccugaucgccccgugguacgccuucgcccucucccggggguucggcagcggcaucaucaccuccaacgcgcccauggacgagugcgacgccaagugccagacgccccagggggccaucaacagcucccugcccuuccagaacgugcacccggucaccaucggcgagugccccaaguacgugcgcagcgccaagcugcggauggugaccgggcuccgcaacauccccuccauccagagccggggccuguucggggccaucgcgggcuucaucgagggcggguggaccggcauggucgacgggugguacggcuaccaccaccagaacgagcagggguccggcuacgccgccgaccagaaguccacccagaacgccaucaacggcaucaccaacaaggugaacagcgugaucgagaagaugaacacgcaguucaccgccgucgggaaggaguucaaccgccuggagcggcgcauggagaaccucaacaagaagguggacgacggcuuccuggacaucuggaccuacaacgcggagcugcucguccugcuggagaacgagcggacccucgacuuccacgacagcaacgugaagaaccuguacgagaaggugaagucccagcugaagaacaacgccaaggagaucgggaacggcugcuucgaguucuaccacaagugcaacaacgagugcauggagagcgucaagaacgggacguacgacuaccccaaguacuccgaggagagcaagcucaaccgcgagaagaucgacggcgugaagcuggaguccaugggcguguaccagauccuggccaucuacagcaccgucgccagcucccucgugcugcuggugagccucggggccaucuccuucuggaugugcagcaacggcucccugcagugccggaucugcaucuga

SEQ ID NO: 63780 - RNA, 1698 nt, Artificial Sequence
  derived and/or modified sequence opt1 from hemagglutinin__InfluenzaA__ACR15315
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacauccgggaccagcgcgcccuguaccacacggagaacgccuacgugagcgucgugagcucccacuacagccggcgcuucacccccgagaucgccaagcggcccaaggugcgcgaccaggagggccggaucaacuacuacuggacccuccuggagcccggggacaccaucaucuucgaggcgaacggcaaccugaucgccccgugguacgccuucgcccucucccgcggguucggcagcggcaucaucacguccaacgcccccaugggggagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggguggaccgggaugguggacggcugguacggguaccaccaccagaacgagcagggcuccggcuacgcggccgaccagaaguccacccagaacgccaucaacgggaucaccaacaaggugaacagcgucaucgagaagaugaacacccaguucacggccgugggcaaggaguucaacaagcuggagcggcgcauggagaaccucaacaagaaggucgacgacggguuccuggacaucuggaccuacaacgccgagcugcucgugcugcuggagaacgagcggacccucgacuuccacgacagcaacgugaagaaccuguacgagaaggucaagucccagcugaagaacaacgcgaaggagaucggcaacgggugcuucgaguucuaccacaagugcaacaacgagugcauggagagcgugaagaacggcaccuacgacuaccccaaguacuccgaggagagcaagcucaaccgcgagaagaucgacggcgugaagcuggaguccaugggggucuaccagauccuggccaucuacagcacgguggccagcucccucgugcugcuggucagccucggcgccaucuccuucuggaugugcagcaacgggucccugcagugccggaucugcaucuga

SEQ ID NO: 63781 - RNA, 1698 nt, Artificial Sequence
  derived and/or modified sequence opt1 from hemagglutinin__InfluenzaA__ACR15326
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagcuccugaucagcaaggaguccuggagcuacaucgucgagacccccaaccccgagaacggcacgugcuaccccggcuacuucgccgacuacgaggagcugcgcgagcagcucuccagcguguccagcuucgagcgguucgagaucuucccgaagggguccagcuggcccaaccacaccgugaccggcgucuccgccagcugcucccacaacggcaagagcuccuucuaccgcaaccugcuguggcucaccgggaagaacgggcuguaccccaaccugagcauguccuacgugaacaacaaggagaaggaggugcucguccuguggggcgugcaccacccgcccaacaucggcaaccagcgggcccuguaccacacggagaacgccuacgugagcgucgugagcucccacuacagccgccgguucacccccgagaucgccaagcgccccaaggugcgggaccaggaggggcgcaucaacuacuacuggacccuccuggagcccggcgacaccaucaucuucgaggcgaacgggaaccugaucgccccgugguacgccuucgcccucucccggggcuucggcagcgggaucaucacguccaacgcccccaugggcgagugcgacgagaagugccagacgccccagggggcgaucaacagcucccugcccuuccagaacguccacccggugaccaucggcgagugccccaaguacgugcgcagcgccaagcugcggauggucaccgggcuccgcaacauccccuccauccagagccggggccuguucggcgccaucgccggguucaucgagggcggguggaccggcaugguggacgggugguacggcuaccaccaccagaacgagcagggcuccggguacgccgcggaccagaaguccacccagaacgccaucaacggcaucaccaacaaggugaacagcgucaucgagaagaugaacacccaguucacggccguggggaaggaguucaacaagcuggagcgccggauggagaaccucaacaagaaggucgacgacggcuuccuggacaucuggaccuacaacgccgagcugcucgugcugcuggagaacgagcgcacccucgacuuccacgacagcaacgugaagaaccuguacgagaaggucaagucccagcugaagaacaacgccaaggagaucgggaacggcugcuucgaguucuaccacaagugcaacaacgagugcauggagagcgugaagaacggcaccuacgacuaccccaaguacuccgaggagagcaagcucaaccgggagaagaucgacggggugaagcuggaguccaugggcgucuaccagauccuggcgaucuacagcacgguggccagcucccucgugcugcuggucagccucggggccaucuccuucuggaugugcagcaacggcucccugcagugccgcaucugcaucuga

SEQ ID NO: 63782 - RNA, 1698 nt, Artificial Sequence
  derived and/or modified sequence opt1 from hemagglutinin__InfluenzaA__ACR15359
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcggccuccugaucagcaaggaguccuggagcuacaucguggagaagcccaaccccgagaacgggaccugcuaccccgggcacuucgccgacuacgaggagcugcgcgagcagcucuccagcguguccagcuucgagcgguucgagaucuucccgaaggaguccagcuggcccaaccacacggucaccggcguguccgccagcugcucccacaacggggagagcuccuucuaccgcaaccugcuguggcucaccggcaagaacgggcuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucucccgcggcuucggcagcgggaucaucaacuccaacgcccccauggacaagugcgacgcgaagugccagacgccccagggcgccaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggcuggaccgggaugguggacggcugguacggguaccaccaccagaacgagcagggcuccggcuacgcggccgaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaaggucgacgacggguucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgugaagcucgaguccaugggggucuaccagauccuggccaucuacagcaccguggccagcucccuggugcuccuggucagccugggcgccaucuccuucuggaugugcagcaacgggucccuccagugccggaucugcaucuga

SEQ ID NO: 63783 - RNA, 1698 nt, Artificial Sequence
  derived and/or modified sequence opt1 from hemagglutinin__InfluenzaA__ACR15370
augaaggugaagcugcucguccugcugugcacccucaccgccacguacgccgacaccaucugcaucggcuaccacgcgaacaacagcaccgacaccguggacacggugcuggagaagaacgucaccgugacccacuccgugaaccugcucgagaacagccacaacgggaagcugugccugcucaagggcaucgcgccccugcagcuggggaacugcuccgucgccggcuggauccucgggaacccggagugcgagcugcugaucagcaaggaguccuggagcuacaucguggagaagcccaaccccgagaacgggaccugcuaccccggccacuucgccgacuacgaggagcuccgcgagcagcuguccagcguguccagcuucgagcgguucgagaucuucccgaaggaguccagcuggcccaaccacacggucaccgggguguccgccagcugcucccacaacggcgagagcuccuucuaccgcaaccugcucuggcugaccgggaagaacggccuguaccccaaccucagcaaguccuacgccaacaacaaggagaaggaggugcugguccuguggggcgugcaccacccgcccaacaucggcgaccagaaggcccucuaccacaccgagaacgccuacgugagcgucgugagcucccacuacagccggaaguucacgcccgagaucgccaagcgccccaaggugcgggaccaggagggccgcaucaacuacuacuggacccugcuggagcccggggacaccaucaucuucgaggcgaacggcaaccucaucgccccgcgguacgccuucgcccugucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcuccgcauggucaccgggcugcggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcucgagcggcgcauggagaaccugaacaagaaggucgacgacggcuucaucgacaucuggaccuacaacgccgagcugcucgugcugcuggagaacgagcggacgcucgacuuccacgacagcaacgugaagaaccuguacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcucaaccgcgagaagaucgacggcgugaagcuggaguccaugggcgucuaccagauccuggccaucuacagcaccguggccagcucccucauccugcuggugagccucggggccaucuccuucuggaugugcagcaacggcucccugcagugccggaucugcaucuga

SEQ ID NO: 63784 - RNA, 1701 nt, Artificial Sequence; identical to SEQ ID NO: 63309
  derived and/or modified sequence opt1 from hemagglutinin__InfluenzaA__ACR15381

SEQ ID NO: 63785 - RNA, 1701 nt, Artificial Sequence; identical to SEQ ID NO: 63316
  derived and/or modified sequence opt1 from hemagglutinin__InfluenzaA__ACR15392

SEQ ID NO: 63786 - RNA, 1701 nt, Artificial Sequence; identical to SEQ ID NO: 62936
  derived and/or modified sequence opt1 from hemagglutinin__InfluenzaA__ACR15403

SEQ ID NO: 63787 - RNA, 1701 nt, Artificial Sequence; identical to SEQ ID NO: 62936
  derived and/or modified sequence opt1 from hemagglutinin__InfluenzaA__ACR15414

SEQ ID NO: 63788 - RNA, 1698 nt, Artificial Sequence; identical to SEQ ID NO: 63782
  derived and/or modified sequence opt1 from hemagglutinin__InfluenzaA__ACR15425

SEQ ID NO: 63789 - RNA, 1698 nt, Artificial Sequence
  derived and/or modified sequence opt1 from hemagglutinin__InfluenzaA__ACR15436
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggggaaggaggugcucguccuguggggcgugcaccacccgcccaacaucggcgaccagaacacccuguaccacacggagaacgccuacgugagcgucgugagcucccacuacagccggaaguucacccccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucucccgcggcuucggcagcgggaucaucaacuccaacgcccccauggacaagugcgacgccaagugccagacgccccagggcgcgaucaacagcucccugcccuuccagaacguccacccggugaccaucggggagugccccaaguacgugcggagcgccaagcugcgcauggucaccggccuccggaacauccccuccauccagagccgcgggcuguucggcgccaucgccggcuucaucgagggcggcuggaccgggaugguggacggcugguacggguaccaccaccagaacgagcagggcuccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgugaagcucgaguccaugggggucuaccagauccuggcgaucuacagcaccguggccagcucccuggugcuccuggucagccugggcgccaucuccuucuggaugugcagcaacgggucccuccagugccggaucugcaucuga

SEQ ID NO: 63790 - RNA, 1698 nt, Artificial Sequence
  derived and/or modified sequence opt1 from hemagglutinin__InfluenzaA__ACR15458
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaaccccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 63791 - RNA, 1698 nt, Artificial Sequence
  derived and/or modified sequence opt1 from hemagglutinin__InfluenzaA__ACR15469
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccgaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaacacccuguaccacacggagaacgccuacgugagcgucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccaugggcgucuaccagauccuggcgaucuacagcaccguggccagcucccuggugcuccuggucagccugggggccaucuccuucuggaugugcagcaacggcucccuccagugccggaucugcaucuga

SEQ ID NO: 63792 - RNA, 1698 nt, Artificial Sequence; identical to SEQ ID NO: 63789
  derived and/or modified sequence opt1 from hemagglutinin__InfluenzaA__ACR15480

SEQ ID NO: 63793 - RNA, 1698 nt, Artificial Sequence
  derived and/or modified sequence opt1 from hemagglutinin__InfluenzaA__ACR15491
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggcggaacggccuguaccccaaccugagcaaguccuacgccaacaacaaggagaaggaggugcucguccuguggggcgugcaccacccgcccaacaucguggaccagaagacccuguaccgcacggagaacgccuacgucagcguggugagcucccacuacagccggaaguucacccccgagaucgccaagcgccccaagguccgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccggagcgccaagcugcgcauggugaccggccuccggaacauccccuccauccagagccgcgggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacgggaucaagcucgaguccaugggcgucuaccagauccuggcgaucuacagcaccguggccagcucccuggugcuccuggucagccugggcgccaucuccuucuggaugugcagcaacgggucccuccagugccggaucugcaucuga

SEQ ID NO: 63794 - RNA, 1698 nt, Artificial Sequence
  derived and/or modified sequence opt1 from hemagglutinin__InfluenzaA__ACR15502
augaaggugaagcugcucguccugcugugcaccuucaccgccacguacgccgacaccaucugcaucggcuaccacgcgaacaacgccaccgacaccguggacacggugcucgagaagaacgucaccgugacccacagcgugaaccugcuggagaacucccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugagcuccuucgagcgguucgagaucuucccgaaggagagcuccuggcccaaccacacggucaccggggugagcgccuccugcagccacaacggcgaguccagcuucuaccgcaaccugcuguggcucaccgggaagaacggccuguaccccaaccuguccaagagcuacgccaacaacaaggggaaggaggugcucguccuguggggcgugcaccacccgcccaacaucggcgaccagaacacccuguaccacacggagaacgccuacguguccgucgugagcagccacuacucccggaaguucacccccgagaucgccaagcgccccaaggugcgggaccaggaggggcgcaucaacuacuacuggacccuccuggagcccggcgacaccaucaucuucgaggcgaacgggaaccugaucgccccgcgguacgccuucgcccucagccgcggcuucggcuccgggaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggcuggaccgggaugguggacggcugguacggguaccaccaccagaacgagcagggcagcggcuacgcggccgaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggcgugaagcucgagagcaugggggucuaccagauccuggccaucuacuccaccguggccagcagccuggugcuccuggucucccugggcgccaucagcuucuggaugugcuccaacgggagccuccagugccggaucugcaucuga

SEQ ID NO: 63795 - RNA, 1698 nt, Artificial Sequence; identical to SEQ ID NO: 63651
  derived and/or modified sequence opt1 from hemagglutinin__InfluenzaA__ACR15513

SEQ ID NO: 63796 - RNA, 1701 nt, Artificial Sequence
  derived and/or modified sequence opt1 from hemagglutinin__InfluenzaA__ACR15524
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaagagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacgugcccagccgcaucuccaucuacuggaccaucgugaaguccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagaagcagacgcggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagaccaacgagaaguuccaccagaucgagaaggaguucagcgagguggaggggcgcauccaggaccuggagaaguacguggaggacacgaagaucgaccugugguccuacaacgccgagcuccuggucgcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggacguacgaccacgacguguaccgggacgaggcccucaacaaccgcuuccagaucaagggcguggagcucaagagcggcuacaaggacuggauccuguggaucuccuucgccaucagcugcuuccugcugugcgucgugcugcucggguucaucaugugggccugccagaagggcaacauccggugcaacaucugcaucuga

SEQ ID NO: 63797 - RNA, 1701 nt, Artificial Sequence; identical to SEQ ID NO: 63605
  derived and/or modified sequence opt1 from hemagglutinin__InfluenzaA__ACR15535

SEQ ID NO: 63798 - RNA, 1701 nt, Artificial Sequence
  derived and/or modified sequence opt1 from hemagglutinin__InfluenzaA__ACR15546
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccacauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacaucagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgugaaccgcaucaccuacggcgccugcccgcgguacgucaagcagaacacccugaagcucgccaccgggaugcgcaacgugcccgagacgcagacccggggcaucuucggggccaucgccggcuucaucgagaacggcugggaggggaugguggacggcugguacggguuccgccaccagaacagcgagggcaccgggcaggccgccgaccugaaguccacccaggcggccaucaaccagaucaacggcaagcugaaccggcucaucggcaagacgaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacaccaucgaccucaccgacagcgagaugaacaagcuguucgagcggacgaagaagcagcugcgcgagaacgccgaggacaugggcaacgggugcuucaagaucuaccacaagugcgacaacgcgugcaucggcuccauccgcaacgagaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 63799 - RNA, 1701 nt, Artificial Sequence; identical to SEQ ID NO: 63380
  derived and/or modified sequence opt1 from hemagglutinin__InfluenzaA__ACR15557

SEQ ID NO: 63800 - RNA, 1701 nt, Artificial Sequence; identical to SEQ ID NO: 61638
  derived and/or modified sequence opt1 from hemagglutinin__InfluenzaA__ACR15568

SEQ ID NO: 63801 - RNA, 1701 nt, Artificial Sequence
  derived and/or modified sequence opt1 from hemagglutinin__InfluenzaA__ACR15579
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaaccccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 63802 - RNA, 1701 nt, Artificial Sequence
  derived and/or modified sequence opt1 from hemagglutinin__InfluenzaA__ACR15590
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccgggggcaucugcgacagcccccaccagauccucgacggggagaacugcacgcugaucgacgcccugcucggcgacccccagugcgacggcuuccagaacaagaagugggaccuguucguggagcgcagcaaggccuacuccaacugcuaccccuacgacgugccggacuacgccagccugcggucccucgucgcgagcuccgggacccuggaguucaacaacgagagcuucaacuggaccggcgugacccagaacgggacguccagcgccugcaagcgccgguccaacaacagcuucuucucccgccugaacuggcucacccaccugaaguucaaguaccccgcccugaacgugaccaugcccaacaacgagaaguucgacaagcucuacaucuggggcguccaccaccccgggaccgacaacgaccagaucuuccuguacgcccaggcgagcggccggaucacgguguccaccaagcgcagccagcagaccgugaucccgaacaucggcagccggccccgcguccggaacauccccucccgcaucagcaucuacuggaccaucgugaagcccggggacauccugcucaucaacuccacgggcaaccugaucgccccgcggggguacuucaagauccgcagcggcaaguccagcaucaugcgguccgacgcccccaucggcaagugcaacagcgagugcaucacccccaacggguccauccccaacgacaagccguuccagaacgugaaccgcaucaccuacggcgccugcccccgguacgucaagcagaacacccugaagcucgccacggggaugcgcaacgugcccgagaagcagacccggggcaucuucggggcgaucgccggcuucaucgagaacggcugggaggggaugguggacggcugguacggguuccgccaccagaacagcgagggcaucgggcaggccgccgaccugaaguccacccaggccgcgaucaaccagaucaacggcaagcugaaccggcucaucggcaagaccaacgagaaguuccaccagaucgagaaggaguucagcgaggucgaggggcgcauccaggaccuggagaaguacguggaggacacgaagaucgaccugugguccuacaacgccgagcuccugguggcccuggagaaccagcacaccaucgaccucaccgacagcgagaugaacaagcuguucgagcggaccaagaagcagcugcgcgagaacgccgaggacaugggcaacgggugcuucaagaucuaccacaagugcgacaacgccugcaucggcuccauccgcaacgggacguacgaccacgacgucuaccgggacgaggcgcucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 63803 - RNA, 1701 nt, Artificial Sequence; identical to SEQ ID NO: 61638
  derived and/or modified sequence opt1 from hemagglutinin__InfluenzaA__ACR15601

SEQ ID NO: 63804 - RNA, 1701 nt, Artificial Sequence
  derived and/or modified sequence opt1 from hemagglutinin__InfluenzaA__ACR18920
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacauccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 63805 - RNA, 1701 nt, Artificial Sequence; identical to SEQ ID NO: 63677
  derived and/or modified sequence opt1 from hemagglutinin__InfluenzaA__ACR18975

SEQ ID NO: 63806 - RNA, 1701 nt, Artificial Sequence; identical to SEQ ID NO: 63664
  derived and/or modified sequence opt1 from hemagglutinin__InfluenzaA__ACR18976

SEQ ID NO: 63807 - RNA, 1701 nt, Artificial Sequence; identical to SEQ ID NO: 63664
  derived and/or modified sequence opt1 from hemagglutinin__InfluenzaA__ACR18977

SEQ ID NO: 63808 - RNA, 1701 nt, Artificial Sequence; identical to SEQ ID NO: 63677
  derived and/or modified sequence opt1 from hemagglutinin__InfluenzaA__ACR18978

SEQ ID NO: 63809 - RNA, 1701 nt, Artificial Sequence; identical to SEQ ID NO: 63664
  derived and/or modified sequence opt1 from hemagglutinin__InfluenzaA__ACR18979

SEQ ID NO: 63810 - RNA, 1701 nt, Artificial Sequence; identical to SEQ ID NO: 63730
  derived and/or modified sequence opt1 from hemagglutinin__InfluenzaA__ACR18981

SEQ ID NO: 63811 - RNA, 1701 nt, Artificial Sequence; identical to SEQ ID NO: 63664
  derived and/or modified sequence opt1 from hemagglutinin__InfluenzaA__ACR18982

SEQ ID NO: 63812 - RNA, 1701 nt, Artificial Sequence; identical to SEQ ID NO: 63677
  derived and/or modified sequence opt1 from hemagglutinin__InfluenzaA__ACR18988

SEQ ID NO: 63813 - RNA, 1701 nt, Artificial Sequence
  derived and/or modified sequence opt1 from hemagglutinin__InfluenzaA__ACR18991
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaaccgcaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacgggacgugcuaccccggcgacuucaucgacuacgaggagcuccgggagcagcugagcuccgugagcuccuucgagcgguucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggguccagccgcuacuccaagaaguucaagcccgagaucgccauccggccgaagguccgcgaccaggagggccggaugaacuacuacuggacgcugguggagcccggcgacaagaucaccuucgaggcgaccgggaaccucguggucccccgcuacgccuucgccauggagcggaacgccggcagcgggaucaucaucuccgacacccccgugcacgacugcaacacgaccugccagaccccgaagggcgccaucaacaccagccugcccuuccagaacauccaccccaucacgaucggcaagugccccaaguacgugaaguccaccaagcugcgccucgcgaccgggcugcggaacgucccgagcauccagucccgcggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccguggggaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgcgaggagaucgacggggugaagcucgaguccacccggaucuaccagauccuggcgaucuacagcaccgucgccagcucccuggugcucguggucagccugggcgccaucuccuucuggaugugcagcaacgggucccugcagugccgcaucugcaucuga

SEQ ID NO: 63814 - RNA, 1701 nt, Artificial Sequence; identical to SEQ ID NO: 63664
  derived and/or modified sequence opt1 from hemagglutinin__InfluenzaA__ACR18993

SEQ ID NO: 63815 - RNA, 1701 nt, Artificial Sequence; identical to SEQ ID NO: 63703
  derived and/or modified sequence opt1 from hemagglutinin__InfluenzaA__ACR18995

SEQ ID NO: 63816 - RNA, 1701 nt, Artificial Sequence; identical to SEQ ID NO: 63725
  derived and/or modified sequence opt1 from hemagglutinin__InfluenzaA__ACR23302

SEQ ID NO: 63817 - RNA, 1701 nt, Artificial Sequence; identical to SEQ ID NO: 63677
  derived and/or modified sequence opt1 from hemagglutinin__InfluenzaA__ACR33743

SEQ ID NO: 63818 - RNA, 1701 nt, Artificial Sequence; identical to SEQ ID NO: 63664
  derived and/or modified sequence opt1 from hemagglutinin__InfluenzaA__ACR38821

SEQ ID NO: 63819 - RNA, 1701 nt, Artificial Sequence; identical to SEQ ID NO: 63664
  derived and/or modified sequence opt1 from hemagglutinin__InfluenzaA__ACR38822

SEQ ID NO: 63820 - RNA, 1701 nt, Artificial Sequence; identical to SEQ ID NO: 63664
  derived and/or modified sequence opt1 from hemagglutinin__InfluenzaA__ACR38823

SEQ ID NO: 63821 - RNA, 1701 nt, Artificial Sequence; identical to SEQ ID NO: 63730
  derived and/or modified sequence opt1 from hemagglutinin__InfluenzaA__ACR38824

SEQ ID NO: 63822 - RNA, 1701 nt, Artificial Sequence
  derived and/or modified sequence opt1 from hemagglutinin__InfluenzaA__ACR38825
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggcgaucuacuccaccguggccagcagccugguccucguggugucccugggcgccaucagcuucuggaugugcuccaacggcagccugcagugccggaucugcaucuga

SEQ ID NO: 63823 - RNA, 1701 nt, Artificial Sequence; identical to SEQ ID NO: 63677
  derived and/or modified sequence opt1 from hemagglutinin__InfluenzaA__ACR38826

SEQ ID NO: 63824 - RNA, 1701 nt, Artificial Sequence; identical to SEQ ID NO: 63664
  derived and/or modified sequence opt1 from hemagglutinin__InfluenzaA__ACR38827

SEQ ID NO: 63825 - RNA, 1701 nt, Artificial Sequence; identical to SEQ ID NO: 63730
  derived and/or modified sequence opt1 from hemagglutinin__InfluenzaA__ACR38828

SEQ ID NO: 63826 - RNA, 1701 nt, Artificial Sequence; identical to SEQ ID NO: 63664
  derived and/or modified sequence opt1 from hemagglutinin__InfluenzaA__ACR38829

SEQ ID NO: 63827 - RNA, 1701 nt, Artificial Sequence; identical to SEQ ID NO: 63703
  derived and/or modified sequence opt1 from hemagglutinin__InfluenzaA__ACR38830

SEQ ID NO: 63828 - RNA, 1701 nt, Artificial Sequence; identical to SEQ ID NO: 63677
  derived and/or modified sequence opt1 from hemagglutinin__InfluenzaA__ACR39354

SEQ ID NO: 63829 - RNA, 1701 nt, Artificial Sequence; identical to SEQ ID NO: 63677
  derived and/or modified sequence opt1 from hemagglutinin__InfluenzaA__ACR39393

SEQ ID NO: 63830 - RNA, 1701 nt, Artificial Sequence; identical to SEQ ID NO: 63677
  derived and/or modified sequence opt1 from hemagglutinin__InfluenzaA__ACR39403

SEQ ID NO: 63831 - RNA, 1701 nt, Artificial Sequence; identical to SEQ ID NO: 63677
  derived and/or modified sequence opt1 from hemagglutinin__InfluenzaA__ACR39413

SEQ ID NO: 63832 - RNA, 1701 nt, Artificial Sequence; identical to SEQ ID NO: 63677
  derived and/or modified sequence opt1 from hemagglutinin__InfluenzaA__ACR39423

SEQ ID NO: 63833 - RNA, 1701 nt, Artificial Sequence; identical to SEQ ID NO: 63677
  derived and/or modified sequence opt1 from hemagglutinin__InfluenzaA__ACR39433

SEQ ID NO: 63834 - RNA, 1701 nt, Artificial Sequence; identical to SEQ ID NO: 63677
  derived and/or modified sequence opt1 from hemagglutinin__InfluenzaA__ACR39443

SEQ ID NO: 63835 - RNA, 1701 nt, Artificial Sequence
  derived and/or modified sequence opt1 from hemagglutinin__InfluenzaA__ACR39453
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 63836 - RNA, 1701 nt, Artificial Sequence; identical to SEQ ID NO: 63677
  derived and/or modified sequence opt1 from hemagglutinin__InfluenzaA__ACR39463

SEQ ID NO: 63837 - RNA, 1701 nt, Artificial Sequence; identical to SEQ ID NO: 63677
  derived and/or modified sequence opt1 from hemagglutinin__InfluenzaA__ACR39473

SEQ ID NO: 63838 - RNA, 1701 nt, Artificial Sequence; identical to SEQ ID NO: 63677
  derived and/or modified sequence opt1 from hemagglutinin__InfluenzaA__ACR39483

SEQ ID NO: 63839 - RNA, 1701 nt, Artificial Sequence; identical to SEQ ID NO: 63677
  derived and/or modified sequence opt1 from hemagglutinin__InfluenzaA__ACR39493

SEQ ID NO: 63840 - RNA, 1701 nt, Artificial Sequence; identical to SEQ ID NO: 63677
  derived and/or modified sequence opt1 from hemagglutinin__InfluenzaA__ACR40288

SEQ ID NO: 63841 - RNA, 1701 nt, Artificial Sequence; identical to SEQ ID NO: 63677
  derived and/or modified sequence opt1 from hemagglutinin__InfluenzaA__ACR40298

SEQ ID NO: 63842 - RNA, 1701 nt, Artificial Sequence
  derived and/or modified sequence opt1 from hemagglutinin__InfluenzaA__ACR40308
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacaucuaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 63843 - RNA, 1701 nt, Artificial Sequence; identical to SEQ ID NO: 63677
  derived and/or modified sequence opt1 from hemagglutinin__InfluenzaA__ACR40318

SEQ ID NO: 63844 - RNA, 1701 nt, Artificial Sequence; identical to SEQ ID NO: 63677
  derived and/or modified sequence opt1 from hemagglutinin__InfluenzaA__ACR40328

SEQ ID NO: 63845 - RNA, 1701 nt, Artificial Sequence; identical to SEQ ID NO: 63677
  derived and/or modified sequence opt1 from hemagglutinin__InfluenzaA__ACR40338

SEQ ID NO: 63846 - RNA, 1701 nt, Artificial Sequence; identical to SEQ ID NO: 63677
  derived and/or modified sequence opt1 from hemagglutinin__InfluenzaA__ACR40348

SEQ ID NO: 63847 - RNA, 1701 nt, Artificial Sequence; identical to SEQ ID NO: 63677
  derived and/or modified sequence opt1 from hemagglutinin__InfluenzaA__ACR40358

SEQ ID NO: 63848 - RNA, 1701 nt, Artificial Sequence; identical to SEQ ID NO: 63677
  derived and/or modified sequence opt1 from hemagglutinin__InfluenzaA__ACR40378

SEQ ID NO: 63849 - RNA, 1701 nt, Artificial Sequence; identical to SEQ ID NO: 63677
  derived and/or modified sequence opt1 from hemagglutinin__InfluenzaA__ACR40388

SEQ ID NO: 63850 - RNA, 1701 nt, Artificial Sequence; identical to SEQ ID NO: 63664
  derived and/or modified sequence opt1 from hemagglutinin__InfluenzaA__ACR46986

SEQ ID NO: 63851 - RNA, 1701 nt, Artificial Sequence; identical to SEQ ID NO: 63664
  derived and/or modified sequence opt1 from hemagglutinin__InfluenzaA__ACR46988

SEQ ID NO: 63852 - RNA, 1701 nt, Artificial Sequence; identical to SEQ ID NO: 63664
  derived and/or modified sequence opt1 from hemagglutinin__InfluenzaA__ACR46989

SEQ ID NO: 63853 - RNA, 1701 nt, Artificial Sequence; identical to SEQ ID NO: 63664
  derived and/or modified sequence opt1 from hemagglutinin__InfluenzaA__ACR46990

SEQ ID NO: 63854 - RNA, 1701 nt, Artificial Sequence; identical to SEQ ID NO: 63664
  derived and/or modified sequence opt1 from hemagglutinin__InfluenzaA__ACR46992

SEQ ID NO: 63855 - RNA, 1701 nt, Artificial Sequence; identical to SEQ ID NO: 63664
  derived and/or modified sequence opt1 from hemagglutinin__InfluenzaA__ACR46993

SEQ ID NO: 63856 - RNA, 1701 nt, Artificial Sequence; identical to SEQ ID NO: 63664
  derived and/or modified sequence opt1 from hemagglutinin__InfluenzaA__ACR46994

SEQ ID NO: 63857 - RNA, 1701 nt, Artificial Sequence
  derived and/or modified sequence opt1 from hemagglutinin__InfluenzaA__ACR47006
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 63858 - RNA, 1701 nt, Artificial Sequence; identical to SEQ ID NO: 63677
  derived and/or modified sequence opt1 from hemagglutinin__InfluenzaA__ACR49281

SEQ ID NO: 63859 - RNA, 1701 nt, Artificial Sequence
  derived and/or modified sequence opt1 from hemagglutinin__InfluenzaA__ACR49282
augaaggccauccuggugguccuccuguacaccuucgccaccgcgaacgccgacacgcugugcaucggcuaccacgccaacaacagcaccgacaccguggacaccgugcucgagaagaacgucacggugacccacuccguggaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 63860 - RNA, 1701 nt, Artificial Sequence; identical to SEQ ID NO: 63664
  derived and/or modified sequence opt1 from hemagglutinin__InfluenzaA__ACR49283

SEQ ID NO: 63861 - RNA, 1701 nt, Artificial Sequence; identical to SEQ ID NO: 63664
  derived and/or modified sequence opt1 from hemagglutinin__InfluenzaA__ACR49288

SEQ ID NO: 63862 - RNA, 1701 nt, Artificial Sequence; identical to SEQ ID NO: 63703
  derived and/or modified sequence opt1 from hemagglutinin__InfluenzaA__ACR49290

SEQ ID NO: 63863 - RNA, 1701 nt, Artificial Sequence; identical to SEQ ID NO: 63677
  derived and/or modified sequence opt1 from hemagglutinin__InfluenzaA__ACR49291

SEQ ID NO: 63864 - RNA, 1701 nt, Artificial Sequence; identical to SEQ ID NO: 63703
  derived and/or modified sequence opt1 from hemagglutinin__InfluenzaA__ACR49293

SEQ ID NO: 63865 - RNA, 1701 nt, Artificial Sequence; identical to SEQ ID NO: 63703
  derived and/or modified sequence opt1 from hemagglutinin__InfluenzaA__ACR49295

SEQ ID NO: 63866 - RNA, 1701 nt, Artificial Sequence; identical to SEQ ID NO: 63717
  derived and/or modified sequence opt1 from hemagglutinin__InfluenzaA__ACR50993

SEQ ID NO: 63867 - RNA, 1701 nt, Artificial Sequence; identical to SEQ ID NO: 63677
  derived and/or modified sequence opt1 from hemagglutinin__InfluenzaA__ACR50995

SEQ ID NO: 63868 - RNA, 1701 nt, Artificial Sequence; identical to SEQ ID NO: 63677
  derived and/or modified sequence opt1 from hemagglutinin__InfluenzaA__ACR51005

SEQ ID NO: 63869 - RNA, 1701 nt, Artificial Sequence; identical to SEQ ID NO: 63677
  derived and/or modified sequence opt1 from hemagglutinin__InfluenzaA__ACR51015

SEQ ID NO: 63870 - RNA, 1701 nt, Artificial Sequence; identical to SEQ ID NO: 63677
  derived and/or modified sequence opt1 from hemagglutinin__InfluenzaA__ACR51025

SEQ ID NO: 63871 - RNA, 1701 nt, Artificial Sequence; identical to SEQ ID NO: 63677
  derived and/or modified sequence opt1 from hemagglutinin__InfluenzaA__ACR51035

SEQ ID NO: 63872 - RNA, 1701 nt, Artificial Sequence; identical to SEQ ID NO: 63677
  derived and/or modified sequence opt1 from hemagglutinin__InfluenzaA__ACR51045

SEQ ID NO: 63873 - RNA, 1701 nt, Artificial Sequence; identical to SEQ ID NO: 63677
  derived and/or modified sequence opt1 from hemagglutinin__InfluenzaA__ACR51055

SEQ ID NO: 63874 - RNA, 1701 nt, Artificial Sequence; identical to SEQ ID NO: 63664
  derived and/or modified sequence opt1 from hemagglutinin__InfluenzaA__ACR51065

SEQ ID NO: 63875 - RNA, 1701 nt, Artificial Sequence; identical to SEQ ID NO: 63677
  derived and/or modified sequence opt1 from hemagglutinin__InfluenzaA__ACR52368

SEQ ID NO: 63876 - RNA, 1701 nt, Artificial Sequence; identical to SEQ ID NO: 63677
  derived and/or modified sequence opt1 from hemagglutinin__InfluenzaA__ACR52378

SEQ ID NO: 63877 - RNA, 1701 nt, Artificial Sequence; identical to SEQ ID NO: 63677
  derived and/or modified sequence opt1 from hemagglutinin__InfluenzaA__ACR52398

SEQ ID NO: 63878 - RNA, 1701 nt, Artificial Sequence; identical to SEQ ID NO: 63677
  derived and/or modified sequence opt1 from hemagglutinin__InfluenzaA__ACR52408

SEQ ID NO: 63879 - RNA, 1701 nt, Artificial Sequence; identical to SEQ ID NO: 63677
  derived and/or modified sequence opt1 from hemagglutinin__InfluenzaA__ACR52418

SEQ ID NO: 63880 - RNA, 1701 nt, Artificial Sequence; identical to SEQ ID NO: 63677
  derived and/or modified sequence opt1 from hemagglutinin__InfluenzaA__ACR52428

SEQ ID NO: 63881 - RNA, 1701 nt, Artificial Sequence; identical to SEQ ID NO: 63677
  derived and/or modified sequence opt1 from hemagglutinin__InfluenzaA__ACR52438

SEQ ID NO: 63882 - RNA, 1701 nt, Artificial Sequence; identical to SEQ ID NO: 63677
  derived and/or modified sequence opt1 from hemagglutinin__InfluenzaA__ACR52448

SEQ ID NO: 63883 - RNA, 1701 nt, Artificial Sequence; identical to SEQ ID NO: 63677
  derived and/or modified sequence opt1 from hemagglutinin__InfluenzaA__ACR52458

SEQ ID NO: 63884 - RNA, 1701 nt, Artificial Sequence; identical to SEQ ID NO: 63677
  derived and/or modified sequence opt1 from hemagglutinin__InfluenzaA__ACR52468

SEQ ID NO: 63885 - RNA, 1701 nt, Artificial Sequence; identical to SEQ ID NO: 63677
  derived and/or modified sequence opt1 from hemagglutinin__InfluenzaA__ACR52478

SEQ ID NO: 63886 - RNA, 1701 nt, Artificial Sequence; identical to SEQ ID NO: 63677
  derived and/or modified sequence opt1 from hemagglutinin__InfluenzaA__ACR52488

SEQ ID NO: 63887 - RNA, 1701 nt, Artificial Sequence; identical to SEQ ID NO: 63677
  derived and/or modified sequence opt1 from hemagglutinin__InfluenzaA__ACR54045

SEQ ID NO: 63888 - RNA, 1701 nt, Artificial Sequence
  derived and/or modified sequence opt1 from hemagglutinin__InfluenzaA__ACR54047
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcaucaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 63889 - RNA, 1701 nt, Artificial Sequence
  derived and/or modified sequence opt1 from hemagglutinin__InfluenzaA__ACR54964
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucaucgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 63890 - RNA, 1701 nt, Artificial Sequence; identical to SEQ ID NO: 63768
  derived and/or modified sequence opt1 from hemagglutinin__InfluenzaA__ACR54974

SEQ ID NO: 63891 - RNA, 1701 nt, Artificial Sequence; identical to SEQ ID NO: 63677
  derived and/or modified sequence opt1 from hemagglutinin__InfluenzaA__ACR54984

SEQ ID NO: 63892 - RNA, 1701 nt, Artificial Sequence; identical to SEQ ID NO: 63664
  derived and/or modified sequence opt1 from hemagglutinin__InfluenzaA__ACR54994

SEQ ID NO: 63893 - RNA, 1701 nt, Artificial Sequence; identical to SEQ ID NO: 63664
  derived and/or modified sequence opt1 from hemagglutinin__InfluenzaA__ACR55004

SEQ ID NO: 63894 - RNA, 1701 nt, Artificial Sequence; identical to SEQ ID NO: 63857
  derived and/or modified sequence opt1 from hemagglutinin__InfluenzaA__ACR56380

SEQ ID NO: 63895 - RNA, 1701 nt, Artificial Sequence; identical to SEQ ID NO: 63730
  derived and/or modified sequence opt1 from hemagglutinin__InfluenzaA__ACR56390

SEQ ID NO: 63896 - RNA, 1701 nt, Artificial Sequence; identical to SEQ ID NO: 63677
  derived and/or modified sequence opt1 from hemagglutinin__InfluenzaA__ACR56400

SEQ ID NO: 63897 - RNA, 1701 nt, Artificial Sequence; identical to SEQ ID NO: 63677
  derived and/or modified sequence opt1 from hemagglutinin__InfluenzaA__ACR56410

SEQ ID NO: 63898 - RNA, 1701 nt, Artificial Sequence; identical to SEQ ID NO: 63677
  derived and/or modified sequence opt1 from hemagglutinin__InfluenzaA__ACR56420

SEQ ID NO: 63899 - RNA, 1701 nt, Artificial Sequence; identical to SEQ ID NO: 63677
  derived and/or modified sequence opt1 from hemagglutinin__InfluenzaA__ACR56430

SEQ ID NO: 63900 - RNA, 1701 nt, Artificial Sequence; identical to SEQ ID NO: 63677
  derived and/or modified sequence opt1 from hemagglutinin__InfluenzaA__ACR56440

SEQ ID NO: 63901 - RNA, 1698 nt, Artificial Sequence
  derived and/or modified sequence opt1 from hemagglutinin__InfluenzaA__ACR58541
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggcguguccgccagcugcucccacaacggcgagagcuccuucuaccgcaaccugcuguggcucacccggaagaacgggcuguaccccaaccugagcaaguccuacgccaacaacaaggagaaggaggugcucguccuguggggcgugcaccacccgcccaacaucggggaccagaaggcccuguaccacaccgagaacgccuacgugagcgucgugagcucccacuacagccgcaaguucacgcccgagaucgccaagcggcccaaggugcgcgaccaggagggccggaucaacuacuacuggacccuccuggagcccggcgacaccaucaucuucgaggcgaacgggaaccugaucgccccgcgcuacgccuucgcccucucccggggcuucgggagcggcaucaucaacuccaacgcccccauggacaagugcgacgcgaagugccagacgccccagggcgccaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggguucaucgagggcggcuggaccgggaugguggacggcugguacggguaccaccaccagaacgagcagggcuccggguacgcggccgaccagaaguccacccagaacgccaucaacggcaucacgaacaaggugaacagcgucaucgacaagaugaacacccaguucaccgccgugggcaaggaguucaacaagcuggagcgccggauggagaaccucaacaagaaggucgacgacggguucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucggcaacgggugcuucgaguucuaccacaagugcaacgacgagugcauggagagcgugaagaacggcaccuacgacuaccccaaguacuccgaggagagcaagcugaaccgggagaagaucgacggggugaagcucgaguccaugggcgucuaccagauccuggccaucuacagcaccguggccagcucccuggugcuccuggucagccugggcgccaucuccuucuggaugugcagcaacgggucccuccagugccgcaucugcaucuga

SEQ ID NO: 63902 - RNA, 1698 nt, Artificial Sequence; identical to SEQ ID NO: 62922
  derived and/or modified sequence opt1 from hemagglutinin__InfluenzaA__ACR61655

SEQ ID NO: 63903 - RNA, 1698 nt, Artificial Sequence; identical to SEQ ID NO: 62938
  derived and/or modified sequence opt1 from hemagglutinin__InfluenzaA__ACR61666

SEQ ID NO: 63904 - RNA, 1701 nt, Artificial Sequence; identical to SEQ ID NO: 63442
  derived and/or modified sequence opt1 from hemagglutinin__InfluenzaA__ACR61677

SEQ ID NO: 63905 - RNA, 1701 nt, Artificial Sequence; identical to SEQ ID NO: 63442
  derived and/or modified sequence opt1 from hemagglutinin__InfluenzaA__ACR61688

SEQ ID NO: 63906 - RNA, 1701 nt, Artificial Sequence; identical to SEQ ID NO: 63442
  derived and/or modified sequence opt1 from hemagglutinin__InfluenzaA__ACR61699

SEQ ID NO: 63907 - RNA, 1701 nt, Artificial Sequence; identical to SEQ ID NO: 63664
  derived and/or modified sequence opt1 from hemagglutinin__InfluenzaA__ACR67170

SEQ ID NO: 63908 - RNA, 1701 nt, Artificial Sequence; identical to SEQ ID NO: 63703
  derived and/or modified sequence opt1 from hemagglutinin__InfluenzaA__ACR67171

SEQ ID NO: 63909 - RNA, 1701 nt, Artificial Sequence; identical to SEQ ID NO: 63664
  derived and/or modified sequence opt1 from hemagglutinin__InfluenzaA__ACR67172

SEQ ID NO: 63910 - RNA, 1701 nt, Artificial Sequence; identical to SEQ ID NO: 63664
  derived and/or modified sequence opt1 from hemagglutinin__InfluenzaA__ACR67177

SEQ ID NO: 63911 - RNA, 1701 nt, Artificial Sequence; identical to SEQ ID NO: 63664
  derived and/or modified sequence opt1 from hemagglutinin__InfluenzaA__ACR67181

SEQ ID NO: 63912 - RNA, 1701 nt, Artificial Sequence
  derived and/or modified sequence opt1 from hemagglutinin__InfluenzaA__ACR67183
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccgcgagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 63913 - RNA, 1701 nt, Artificial Sequence; identical to SEQ ID NO: 63677
  derived and/or modified sequence opt1 from hemagglutinin__InfluenzaA__ACR67184

SEQ ID NO: 63914 - RNA, 1701 nt, Artificial Sequence; identical to SEQ ID NO: 63664
  derived and/or modified sequence opt1 from hemagglutinin__InfluenzaA__ACR67185

SEQ ID NO: 63915 - RNA, 1701 nt, Artificial Sequence; identical to SEQ ID NO: 63857
  derived and/or modified sequence opt1 from hemagglutinin__InfluenzaA__ACR67186

SEQ ID NO: 63916 - RNA, 1701 nt, Artificial Sequence; identical to SEQ ID NO: 63664
  derived and/or modified sequence opt1 from hemagglutinin__InfluenzaA__ACR67187

SEQ ID NO: 63917 - RNA, 1701 nt, Artificial Sequence; identical to SEQ ID NO: 63703
  derived and/or modified sequence opt1 from hemagglutinin__InfluenzaA__ACR67188

SEQ ID NO: 63918 - RNA, 1701 nt, Artificial Sequence; identical to SEQ ID NO: 63703
  derived and/or modified sequence opt1 from hemagglutinin__InfluenzaA__ACR67189

SEQ ID NO: 63919 - RNA, 1701 nt, Artificial Sequence
  derived and/or modified sequence opt1 from hemagglutinin__InfluenzaA__ACR67190
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 63920 - RNA, 1701 nt, Artificial Sequence; identical to SEQ ID NO: 63664
  derived and/or modified sequence opt1 from hemagglutinin__InfluenzaA__ACR67192

SEQ ID NO: 63921 - RNA, 1701 nt, Artificial Sequence
  derived and/or modified sequence opt1 from hemagglutinin__InfluenzaA__ACR67193
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgagugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 63922 - RNA, 1701 nt, Artificial Sequence; identical to SEQ ID NO: 63664
  derived and/or modified sequence opt1 from hemagglutinin__InfluenzaA__ACR67195

SEQ ID NO: 63923 - RNA, 1701 nt, Artificial Sequence; identical to SEQ ID NO: 63664
  derived and/or modified sequence opt1 from hemagglutinin__InfluenzaA__ACR67197

SEQ ID NO: 63924 - RNA, 1701 nt, Artificial Sequence; identical to SEQ ID NO: 63921
  derived and/or modified sequence opt1 from hemagglutinin__InfluenzaA__ACR67198

SEQ ID NO: 63925 - RNA, 1701 nt, Artificial Sequence; identical to SEQ ID NO: 63664
  derived and/or modified sequence opt1 from hemagglutinin__InfluenzaA__ACR67199

SEQ ID NO: 63926 - RNA, 1701 nt, Artificial Sequence; identical to SEQ ID NO: 63677
  derived and/or modified sequence opt1 from hemagglutinin__InfluenzaA__ACR67244

SEQ ID NO: 63927 - RNA, 1701 nt, Artificial Sequence
  derived and/or modified sequence opt1 from hemagglutinin__InfluenzaA__ACR67254
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacguggggagcggcaucaucaucuccgacacccccgugcacgacugcaacacgaccugccagaccccgaagggcgccaucaacaccagccugcccuuccagaacauccaccccaucacgaucgggaagugccccaaguacgucaaguccaccaagcugcggcucgccaccggccugcgcaacgugccgagcauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggucaacagcgugaucgagaagaugaacacccaguucaccgcggucggcaaggaguucaaccaccuggagaagcgcaucgagaaccugaacaagaagguggacgacggcuuccucgacaucuggacguacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggccaucuacagcaccguggcgagcucccuggugcucgucgugagccugggggccaucuccuucuggaugugcagcaacggcucccugcagugccggaucugcaucuga

SEQ ID NO: 63928 - RNA, 1701 nt, Artificial Sequence; identical to SEQ ID NO: 63677
  derived and/or modified sequence opt1 from hemagglutinin__InfluenzaA__ACR77438

SEQ ID NO: 63929 - RNA, 1701 nt, Artificial Sequence; identical to SEQ ID NO: 63677
  derived and/or modified sequence opt1 from hemagglutinin__InfluenzaA__ACR77448

SEQ ID NO: 63930 - RNA, 1701 nt, Artificial Sequence
  derived and/or modified sequence opt1 from hemagglutinin__InfluenzaA__ACR77458
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgacaagugcaacaucgccggguggauccugggcaacccggagugcgagagccuguccaccgccagcuccuggagcuacaucguggagaccuccagcuccgacaacgggacgugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucguggggacgucccgguacagcaagaaguucaagcccgagaucgccauccgcccgaagguccgggaccaggagggccgcaugaacuacuacuggacccugguggagcccggcgacaagaucaccuucgaggcgaccgggaaccucguggucccccgguacgccuucgccauggagcgcaacgccggcuccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccguggggaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacgggagccugcagugccggaucugcaucuga

SEQ ID NO: 63931 - RNA, 1701 nt, Artificial Sequence; identical to SEQ ID NO: 63677
  derived and/or modified sequence opt1 from hemagglutinin__InfluenzaA__ACR77468

SEQ ID NO: 63932 - RNA, 1701 nt, Artificial Sequence; identical to SEQ ID NO: 63677
  derived and/or modified sequence opt1 from hemagglutinin__InfluenzaA__ACR77478

SEQ ID NO: 63933 - RNA, 1701 nt, Artificial Sequence; identical to SEQ ID NO: 63677
  derived and/or modified sequence opt1 from hemagglutinin__InfluenzaA__ACR77488

SEQ ID NO: 63934 - RNA, 1701 nt, Artificial Sequence; identical to SEQ ID NO: 63677
  derived and/or modified sequence opt1 from hemagglutinin__InfluenzaA__ACR77498

SEQ ID NO: 63935 - RNA, 1701 nt, Artificial Sequence; identical to SEQ ID NO: 63664
  derived and/or modified sequence opt1 from hemagglutinin__InfluenzaA__ACR83525

SEQ ID NO: 63936 - RNA, 1701 nt, Artificial Sequence
  derived and/or modified sequence opt1 from hemagglutinin__InfluenzaA__ACR83538
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccugagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacagcaacgugaagaaccuguacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcucaaccgggaggagaucgacggcgugaagcuggagagcacccgcaucuaccagauccuggcgaucuacuccaccgucgccagcagccucgugcugguggucucccugggggccaucagcuucuggaugugcuccaacggcagccuccagugccggaucugcaucuga

SEQ ID NO: 63937 - RNA, 1701 nt, Artificial Sequence; identical to SEQ ID NO: 63677
  derived and/or modified sequence opt1 from hemagglutinin__InfluenzaA__ACS14666

SEQ ID NO: 63938 - RNA, 1701 nt, Artificial Sequence; identical to SEQ ID NO: 63677
  derived and/or modified sequence opt1 from hemagglutinin__InfluenzaA__ACS14676

SEQ ID NO: 63939 - RNA, 1701 nt, Artificial Sequence; identical to SEQ ID NO: 63677
  derived and/or modified sequence opt1 from hemagglutinin__InfluenzaA__ACS14686

SEQ ID NO: 63940 - RNA, 1701 nt, Artificial Sequence; identical to SEQ ID NO: 63677
  derived and/or modified sequence opt1 from hemagglutinin__InfluenzaA__ACS14696

SEQ ID NO: 63941 - RNA, 1701 nt, Artificial Sequence; identical to SEQ ID NO: 63677
  derived and/or modified sequence opt1 from hemagglutinin__InfluenzaA__ACS14706

SEQ ID NO: 63942 - RNA, 1701 nt, Artificial Sequence; identical to SEQ ID NO: 63677
  derived and/or modified sequence opt1 from hemagglutinin__InfluenzaA__ACS14716

SEQ ID NO: 63943 - RNA, 1701 nt, Artificial Sequence; identical to SEQ ID NO: 63677
  derived and/or modified sequence opt1 from hemagglutinin__InfluenzaA__ACS14726

SEQ ID NO: 63944 - RNA, 1701 nt, Artificial Sequence; identical to SEQ ID NO: 63677
  derived and/or modified sequence opt1 from hemagglutinin__InfluenzaA__ACS14736

SEQ ID NO: 63945 - RNA, 1701 nt, Artificial Sequence; identical to SEQ ID NO: 63857
  derived and/or modified sequence opt1 from hemagglutinin__InfluenzaA__ACS27189

SEQ ID NO: 63946 - RNA, 1701 nt, Artificial Sequence; identical to SEQ ID NO: 63677
  derived and/or modified sequence opt1 from hemagglutinin__InfluenzaA__ACS27199

SEQ ID NO: 63947 - RNA, 1701 nt, Artificial Sequence; identical to SEQ ID NO: 63677
  derived and/or modified sequence opt1 from hemagglutinin__InfluenzaA__ACS27209

SEQ ID NO: 63948 - RNA, 1701 nt, Artificial Sequence; identical to SEQ ID NO: 63730
  derived and/or modified sequence opt1 from hemagglutinin__InfluenzaA__ACS27219

SEQ ID NO: 63949 - RNA, 1701 nt, Artificial Sequence; identical to SEQ ID NO: 63677
  derived and/or modified sequence opt1 from hemagglutinin__InfluenzaA__ACS27229

SEQ ID NO: 63950 - RNA, 1701 nt, Artificial Sequence
  derived and/or modified sequence opt1 from hemagglutinin__InfluenzaA__ACS27239
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccaugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggagcggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 63951 - RNA, 1701 nt, Artificial Sequence; identical to SEQ ID NO: 63677
  derived and/or modified sequence opt1 from hemagglutinin__InfluenzaA__ACS27249

SEQ ID NO: 63952 - RNA, 1701 nt, Artificial Sequence; identical to SEQ ID NO: 63677
  derived and/or modified sequence opt1 from hemagglutinin__InfluenzaA__ACS27775

SEQ ID NO: 63953 - RNA, 1701 nt, Artificial Sequence; identical to SEQ ID NO: 63664
  derived and/or modified sequence opt1 from hemagglutinin__InfluenzaA__ACS34705

SEQ ID NO: 63954 - RNA, 1701 nt, Artificial Sequence; identical to SEQ ID NO: 63664
  derived and/or modified sequence opt1 from hemagglutinin__InfluenzaA__ACS34966

SEQ ID NO: 63955 - RNA, 1701 nt, Artificial Sequence
  derived and/or modified sequence opt1 from hemagglutinin__InfluenzaA__ACS34967
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagagccggcuggcgaccggccuccgcaacgucccguccauccagagccgggggcuguucggcgccaucgccggguucaucgagggcggcuggaccgggaugguggacggcugguacggguaccaccaccagaacgagcagggcuccggguacgccgccgaccucaagagcacgcagaaggcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccuggacaucuggacguacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacagcaccgucgccuccagccuggugcugguggucucccucggggccaucagcuucuggaugugcuccaacggcagccugcagugccggaucugcaucuga

SEQ ID NO: 63956 - RNA, 1701 nt, Artificial Sequence
  derived and/or modified sequence opt1 from hemagglutinin__InfluenzaA__ACS34968
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggaguccagcuccagcgacaacgggaccugcuaccccggcgacuucaucgacuacgaggagcuccgggagcagcuguccagcguguccagcuucgagcgcuucgagaucuuccccaagacguccagcuggcccaaccacgacuccaacaagggcgucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcagcucccgguacagcaagaaguucaagcccgagaucgccauccgcccgaagguccgggaccaggagggccgcaugaacuacuacuggacccugguggagcccggggacaagaucaucuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacagcaccgucgccuccagccuggugcucguggucucccugggggccaucagcuucuggaugugcuccaacggcagccugcagugccggaucugcaucuga

SEQ ID NO: 63957 - RNA, 1701 nt, Artificial Sequence
  derived and/or modified sequence opt1 from hemagglutinin__InfluenzaA__ACS36632
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaaggcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 63958 - RNA, 1701 nt, Artificial Sequence
  derived and/or modified sequence opt1 from hemagglutinin__InfluenzaA__ACS36645
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcaccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaaguccaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcaucaagcucgagagcacccgcaucuaccagauccuggccaucuacagcaccguggcguccagccugguccucguggugucccugggggccaucagcuucuggaugugcuccaacggcagccugcagugccggaucugcaucuga

SEQ ID NO: 63959 - RNA, 1701 nt, Artificial Sequence
  derived and/or modified sequence opt1 from hemagglutinin__InfluenzaA__ACS45035
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagacccccuccagcgacaacggcacgugcuaccccggcgacuucaucgacuacgaggagcuccgggagcagcuguccagcguguccagcuucgagcgcuucgagaucuuccccaagaccuccagcuggccgaaccacgacuccaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcaguccaucuaccagaacgccgacacguacguguucgugggcagcucccgguacagcaagaaguucaagccggagaucgccauccgccccaagguccgggaccaggagggccgcaugaacuacuacuggacccugguggagcccggggacaagaucaccuucgaggccaccggcaaccugguggucccccgguacgcguucgccauggagcgcaacgccggguccggcaucaucaucagcgacacgccggugcacgacugcaacacgaccugccagacccccaagggcgccaucaacaccucccuccccuuccagaacauccaccccaucaccaucgggaagugcccgaaguacgucaagagcaccaagcugcggcuggccaccggccuccgcaacauccccuccauccagagccgggggcuguucggcgcgaucgccggguucaucgagggcggcuggacggggaugguggacggcugguacggguaccaccaccagaacgagcagggcuccggguacgccgccgaccucaagagcacccagaacgccaucgacgagaucaccaacaaggugaacuccgugaucgagaagaugaacacccaguucacggcggucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcuggagagcacccgcaucuaccagauccucgccaucuacuccaccguggcgagcagccugguccugguggugucccucggggccaucagcuucuggaugugcuccaacggcagccugcagugccggaucugcaucuga

SEQ ID NO: 63960 - RNA, 1701 nt, Artificial Sequence; identical to SEQ ID NO: 63677
  derived and/or modified sequence opt1 from hemagglutinin__InfluenzaA__ACS50084

SEQ ID NO: 63961 - RNA, 1701 nt, Artificial Sequence; identical to SEQ ID NO: 63919
  derived and/or modified sequence opt1 from hemagglutinin__InfluenzaA__ACS50095

SEQ ID NO: 63962 - RNA, 1701 nt, Artificial Sequence
  derived and/or modified sequence opt1 from hemagglutinin__InfluenzaA__ACS54258
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacuacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 63963 - RNA, 1701 nt, Artificial Sequence; identical to SEQ ID NO: 63692
  derived and/or modified sequence opt1 from hemagglutinin__InfluenzaA__ACS54259

SEQ ID NO: 63964 - RNA, 1701 nt, Artificial Sequence; identical to SEQ ID NO: 63664
  derived and/or modified sequence opt1 from hemagglutinin__InfluenzaA__ACS54260

SEQ ID NO: 63965 - RNA, 1701 nt, Artificial Sequence; identical to SEQ ID NO: 63677
  derived and/or modified sequence opt1 from hemagglutinin__InfluenzaA__ACS54261

SEQ ID NO: 63966 - RNA, 1701 nt, Artificial Sequence; identical to SEQ ID NO: 63677
  derived and/or modified sequence opt1 from hemagglutinin__InfluenzaA__ACS54263

SEQ ID NO: 63967 - RNA, 1701 nt, Artificial Sequence; identical to SEQ ID NO: 63677
  derived and/or modified sequence opt1 from hemagglutinin__InfluenzaA__ACS54301

SEQ ID NO: 63968 - RNA, 1701 nt, Artificial Sequence; identical to SEQ ID NO: 63664
  derived and/or modified sequence opt1 from hemagglutinin__InfluenzaA__ACS66821

SEQ ID NO: 63969 - RNA, 1701 nt, Artificial Sequence
  derived and/or modified sequence opt1 from hemagglutinin__InfluenzaA__ACS68822
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggggcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaagaucgacgacggguuccucgacaucuggaccuacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggccaagcugaaccgggaggagaucgacggggugaagcucgagagcacccgcaucuaccagauccuggcgaucuacuccaccguggccagcagccugguccucguggugucccugggcgccaucagcuucuggaugugcuccaacggcagccugcagugccggaucugcaucuga

SEQ ID NO: 63970 - RNA, 1701 nt, Artificial Sequence; identical to SEQ ID NO: 63677
  derived and/or modified sequence opt1 from hemagglutinin__InfluenzaA__ACS75821

SEQ ID NO: 63971 - RNA, 1701 nt, Artificial Sequence; identical to SEQ ID NO: 63677
  derived and/or modified sequence opt1 from hemagglutinin__InfluenzaA__ACS77926

SEQ ID NO: 63972 - RNA, 1701 nt, Artificial Sequence; identical to SEQ ID NO: 63677
  derived and/or modified sequence opt1 from hemagglutinin__InfluenzaA__ACS77936

SEQ ID NO: 63973 - RNA, 1701 nt, Artificial Sequence; identical to SEQ ID NO: 63770
  derived and/or modified sequence opt1 from hemagglutinin__InfluenzaA__ACS77946

SEQ ID NO: 63974 - RNA, 1701 nt, Artificial Sequence; identical to SEQ ID NO: 63677
  derived and/or modified sequence opt1 from hemagglutinin__InfluenzaA__ACS77956

SEQ ID NO: 63975 - RNA, 1701 nt, Artificial Sequence; identical to SEQ ID NO: 63677
  derived and/or modified sequence opt1 from hemagglutinin__InfluenzaA__ACS77966

SEQ ID NO: 63976 - RNA, 1701 nt, Artificial Sequence; identical to SEQ ID NO: 63677
  derived and/or modified sequence opt1 from hemagglutinin__InfluenzaA__ACS77976

SEQ ID NO: 63977 - RNA, 1701 nt, Artificial Sequence; identical to SEQ ID NO: 63919
  derived and/or modified sequence opt1 from hemagglutinin__InfluenzaA__ACS77986

SEQ ID NO: 63978 - RNA, 1701 nt, Artificial Sequence
  derived and/or modified sequence opt1 from hemagglutinin__InfluenzaA__ACS77996
augaaggccacccuggugguccuccuguacaccuucgccacggcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcacguccgccgaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggcgacgggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgcgacgggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucaccaacaaggugaacuccgucaucgagaagaugaacacgcaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 63979 - RNA, 1701 nt, Artificial Sequence; identical to SEQ ID NO: 63677
  derived and/or modified sequence opt1 from hemagglutinin__InfluenzaA__ACS78006

SEQ ID NO: 63980 - RNA, 1701 nt, Artificial Sequence; identical to SEQ ID NO: 63677
  derived and/or modified sequence opt1 from hemagglutinin__InfluenzaA__ACS78016

SEQ ID NO: 63981 - RNA, 1701 nt, Artificial Sequence
  derived and/or modified sequence opt1 from hemagglutinin__InfluenzaA__ACS78026
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaucagcuccuggcccaaccacgacagcaaccgcggggucaccgccgccugcccgcacgccggcgcgaaguccuucuacaagaaccugaucuggcucgugaagaaggggaacagcuaccccaagcugaucaaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagcccgagaucgccauccggccgaagguccgcgaccaggagggccggaugaacuacuacuggacccugguggagcccggggacaagaucacguucgaggcgaccggcaaccucguggucccccgcuacgccuucgccauggagcggaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcgccucgcgaccggccugcggaacgugccguccauccagagccgcgggcuguucggcgccaucgccggguucaucgagggcggcuggaccgggaugguggacggcugguacggguaccaccaccagaacgagcagggcuccggguacgccgccgaccucaagagcacccagaacgcgaucgacgagaucacgaacaaggugaacuccgucaucgagaagaugaacacccaguucaccgccgugggcaaggaguucaaccaccuggagaagcggaucgagaaccugaacaagaaggucgacgacggcuuccucgacaucuggaccuacaacgccgagcugcuggugcuccuggagaacgagcgcacgcuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 63982 - RNA, 1701 nt, Artificial Sequence; identical to SEQ ID NO: 63919
  derived and/or modified sequence opt1 from hemagglutinin__InfluenzaA__ACS78036

SEQ ID NO: 63983 - RNA, 1701 nt, Artificial Sequence; identical to SEQ ID NO: 63919
  derived and/or modified sequence opt1 from hemagglutinin__InfluenzaA__ACS78046

SEQ ID NO: 63984 - RNA, 1701 nt, Artificial Sequence; identical to SEQ ID NO: 63692
  derived and/or modified sequence opt1 from hemagglutinin__InfluenzaA__ACS92569

SEQ ID NO: 63985 - RNA, 1701 nt, Artificial Sequence; identical to SEQ ID NO: 63692
  derived and/or modified sequence opt1 from hemagglutinin__InfluenzaA__ACS92579

SEQ ID NO: 63986 - RNA, 1701 nt, Artificial Sequence; identical to SEQ ID NO: 63677
  derived and/or modified sequence opt1 from hemagglutinin__InfluenzaA__ACS92589

SEQ ID NO: 63987 - RNA, 1701 nt, Artificial Sequence
  derived and/or modified sequence opt1 from hemagglutinin__InfluenzaA__ACS92612
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccauccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcgacacgaccugccagaccccgaagggcgccaucaacaccagccugcccuuccagaacauccaccccaucacgaucgggaagugccccaaguacgugaaguccaccaagcugcggcucgcgaccggccugcgcaacaucccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 63988 - RNA, 1701 nt, Artificial Sequence; identical to SEQ ID NO: 63677
  derived and/or modified sequence opt1 from hemagglutinin__InfluenzaA__ACT10307

SEQ ID NO: 63989 - RNA, 1701 nt, Artificial Sequence; identical to SEQ ID NO: 63677
  derived and/or modified sequence opt1 from hemagglutinin__InfluenzaA__ACT10314

SEQ ID NO: 63990 - RNA, 1701 nt, Artificial Sequence
  derived and/or modified sequence opt1 from hemagglutinin__InfluenzaA__ACT11057
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacagcaccguggccagcucccuggugcuggucgugagccucggggccaucuccuucuggaugugcagcaacggcucccugcagugccggaucugcaucuga

SEQ ID NO: 63991 - RNA, 1704 nt, Artificial Sequence
  derived and/or modified sequence opt1 from hemagglutinin__InfluenzaA__ACT15312
auggagaagaucgugcugcuccuggccaucgucagcaucgugaaguccgaccagaucugcaucggcuaccacgccaacaacagcaccgagcaggucgacaccaucauggagaagaacgugacggugacccacgcgcaggacauccuggagaagacccacaacgggaagcucugcaaccuggacggcgugaagccccugauccuccgcgacugcuccgucgccggguggcugcugggcaacccgaugugcgacgaguuccucaacgugcccgaguggagcuacaucguggagaagaucaaccccgccaacgaccugugcuaccccgggaacuucaacgacuacgaggagcugaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaagaacaacgcguaccccacgaucaagcgcuccuacaacaacaccaaccaggaggaccuccugguccugugggggauccaccaccccaacgacgccgccgagcagacccggcucuaccagaacccgaccacguacaucagcgugggcaccuccacccugaaccagcgccuggugcccaagaucgccacccggagcaaggucaacgggcaguccggccgcauggaguucuucuggacgauccucaagagcaacgacgcgaucaacuucgaguccaacgggaacuucaucgcccccgagaacgccuacaagaucgugaagaagggcgacagcaccaucaugaaguccgagcuggaguacggcaacugcaacaccaagugccagacccccaucggggccaucaacagcagcaugccguuccacaacauccacccccugacgaucggcgagugccccaaguacgugaaguccaaccggcucguccuggccaccgggcugcgcaacagcccccagggcgagcggcgccggaagaagcgcggccucuucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacagcaucaucgacaagaugaacacgcaguucgaggcggugggccgggaguucaacaaccuggagcgccggaucgagaaccugaacaagaagauggaggacggguuccucgacguguggaccuacaacgccgagcugcugguccucauggagaacgagcgcacccuggacuuccacgacuccaacgugaagaaccuguacgacaagguccggcuccagcugcgcgacaacgccaaggagcugggcaacggcugcuucgaguucuaccaccggugcgacaacgagugcauggagagcgugcgcaacgggaccuacgacuacccgcaguacuccgaggaggcccgccucaagcgggaggagaucagcggcgugaagcuggaguccaucgggacguaccagauccugagcaucuacuccaccgucgccagcucccucgcgcuggccaucaugguggccggccuguuccucuggaugugcagcaacgggucccugcagugccgcaucugcaucuga

SEQ ID NO: 63992 - RNA, 1704 nt, Artificial Sequence
  derived and/or modified sequence opt1 from hemagglutinin__InfluenzaA__ACT15314
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaagaacaacgcguaccccacgaucaagcgcuccuacaacaacaccaaccaggaggaccugcugguccucugggggauccaccaccccaacgacgccgccgagcagacccggcuguaccagaacccgaccacguacaucagcgugggcaccuccacccugaaccagcgccucgugcccaagaucaccacgcggagcaaggucaacgggcaguccggccgcauggaguucuucuggaccauccucaagagcaacgacgccaucaacuucgaguccaacgggaacuucaucgcgcccgagaacgccuacaagaucgugaagaagggcgacagcaccaucaugaaguccgagcuggaguacggcaacugcaacaccaagugccagacgcccaucggggccaucaacagcagcaugccguuccacaacauccacccccugaccaucggcgagugccccaaguacgugaaguccaaccggcugguccuggccaccgggcuccgcaacagcccccagggcgagcggcgccggaagaagcgcggccuguucggggccaucgcgggcuucaucgagggcggguggcaggggaugguggacggcugguacggcuaccaccacuccaacgagcaggggagcggcuacgccgccgacaaggaguccacccagaaggccaucgacggggugacgaacaaggucaacagcaucaucgacaagaugaacacccaguucgaggccgugggccgggaguucaacaaccuggagcgccggaucgagaaccucaacaagaagauggaggacggguuccuggacguguggaccuacaacgcggagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggacguacgacuacccgcaguacuccgaggaggcccgccugaagcgggaggagaucagcggcgugaagcuggaguccaucgggaccuaccagauccucagcaucuacuccaccgucgccagcucccuggcccuggcgaucaugguggccggccucuuccuguggaugugcagcaacgggucccugcagugccgcaucugcaucuga

SEQ ID NO: 63993 - RNA, 1704 nt, Artificial Sequence
  derived and/or modified sequence opt1 from hemagglutinin__InfluenzaA__ACT15316
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaaggacaacgcguaccccacgaucaagcgcuccuacaacaacaccaaccaggaggaccugcugguccucugggggauccaccaccccaacgacgccgccgagcagacccggcuguaccagaacccgaccacguacaucagcgugggcaccuccacccugaaccagcgccucauccccaagaucgccacccggagcaaggugaacgggcaguccggccgcauggaguucuucuggacgauccucaagagcaacgacgcgaucaacuucgaguccaacgggaacuucaucgcccccgagaacgccuacaagaucgucaagaagggcgacagcaccaucaugaaguccgagcuggaguacggcaacugcaacaccaagugccagacccccaucggggccaucaacagcagcaugccguuccacaacauccacccccugacgaucggcgagugccccaaguacgugaaguccaaccggcuggugcuggccaccgggcuccgcaacagcccccagggcgagcggcgccggaagaagcgcggccuguucggggcgaucgccggcuucaucgagggcggguggcaggggauggucgacggcugguacggcuaccaccacuccaacgagcaggggagcggcuacgccgccgacaaggaguccacccagaaggccaucgacggggugaccaacaaggugaacagcaucaucgacaagaugaacacgcaguucgaggcggucggccgggaguucaacaaccuggagcgccggaucgagaaccucaacaagaagauggaggacggguuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucggcaacggcugcuucgaguucuaccaccggugcgacaacgagugcauggagagcguccgcaacgggaccuacgacuacccgcaguacuccgaggaggcccgccugaagcgggaggagaucagcggcgugaagcuggaguccaucgggacguaccagauccucagcaucuacuccaccguggccagcucccuggcgcuggccaucauggucgccggccucuuccuguggaugugcagcaacgggucccugcagugccgcaucugcaucuga

SEQ ID NO: 63994 - RNA, 1704 nt, Artificial Sequence
  derived and/or modified sequence opt1 from hemagglutinin__InfluenzaA__ACT15320
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacgaggccagcggcauguccagcgccugccccuaccagggccgcuccagcuucuuccggaacgucguguggcugaccaagaaggacaacgcguaccccacgaucaagcgcuccuacaacaacaccaaccaggaggaccugcuggugcucugggggauccaccaccccaacgacgccgccgagcagacccggcuguaccagaacccgaccacguacaucagcgucggcaccuccacccugaaccagcgccucgugcccaagaucgccacccggagcaaggugaacgggcaguccggccgcauggaguucuucuggacgauccucaagagcaacgacgcgaucaacuucgaguccaacgggaacuucaucgcccccgagaacgccuacaagaucgucaagaagggcgacagcaccaucaugaaguccgagcuggaguacggcaacugcaacaccaagugccagacccccaucggggccaucaacagcagcaugccguuccacaacauccacccccugacgaucggcgagugccccaaguacgugaaguccaaccggcuggugcuggccaccgggcuccgcaacagcccccagggcgagcggcgccggaagaagcgcggccuguucggggcgaucgccggcuucaucgagggcggguggcaggggauggucgacggcugguacggcuaccaccacuccaacgagcaggggagcggcuacgccgccgacaaggaguccacccagaaggccaucgacggggugaccaacaaggugaacagcaucaucgacaagaugaacacgcaguucgaggcggucggccgggaguucaacaaccuggagcgccggaucgagaaccucaacaagaagauggaggacggguuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucggcaacggcugcuucgaguucuaccaccggugcgacaacgagugcauggagagcguccgcaacgggaccuacgacuacccgcaguacuccgaggaggcccgccugaagcgggaggagaucagcggcgugaagcuggaguccaucgggacguaccagauccucagcaucuacuccaccguggccagcucccuggcgcuggccaucauggucgccggccucuuccuguggaugugcagcaacgggucccugcagugccgcaucugcaucuga

SEQ ID NO: 63995 - RNA, 1704 nt, Artificial Sequence
  derived and/or modified sequence opt1 from hemagglutinin__InfluenzaA__ACT15322
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaaggacaacgcguaccccacgaucaagcgcuccuacaacaacaccaaccaggaggaccugcugguccucugggggauccaccaccccaacgacgccgccgagcagacccggcuguaccagaacccgaccacguacaucagcgugggcaccuccacccugaaccagcgccucgugcccaagaucgccacccggagcaaggucaacgggcaguccggccgcauggaguucuucuggacgauccucaagagcaacgacgcgaucaacuucgaguccaacgggaacuucaucgcccccgagaacgccuacaagaucgugaagaagggcgacagcaccaucaugaaguccgagcuggaguacggcaacugcaacaccaagugccagacccccaucggggccaucaacagcagcaugccguuccacaacauccacccccugacgaucggcgagugccccaaguacgugaaguccaaccggcugguccuggccaccgggcuccgcaacagcccccagggcgagcggcgccggaagaagcgcggccuguucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacagcaucaucgacaagaugaacacgcaguucgaggcggugggccgggaguucaacaaccuggagucccgcaucgagaaccucaacaagaagauggaggacggguuccuggacguguggaccuacaacgccgagcugcucguccugauggagaacgagcggacccuggacuuccacgacagcaacgugaagaaccucuacgacaagguccgccugcagcugcgggacaacgccaaggagcucggcaacggcugcuucgaguucuaccaccgcugcgacaacgagugcauggaguccgugcggaacgggaccuacgacuacccgcaguacagcgaggaggcccgccugaagcgcgaggagaucuccggcgugaagcuggagagcaucgggacguaccagauccucuccaucuacagcaccgucgccuccagccuggcgcuggccaucaugguggccggccucuuccuguggaugugcuccaacgggagccugcagugccggaucugcaucuga

SEQ ID NO: 63996 - RNA, 1704 nt, Artificial Sequence
  derived and/or modified sequence opt1 from hemagglutinin__InfluenzaA__ACT15326
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaaggacaacgcguaccccacgaucaagcgcuccuacaacaacaccaaccaggaggaccugcugguccucugggggauccaccaccccaacgacgccgccgagcagacccggcuguaccagaacccgaccacguacaucagcgugggcaccuccacccugaaccagcgccucauccccaagaucgccacccggagcaaggugaacgggcaguccggccgcauggaguucuucuggacgauccugaagcccaacgacgcgaucaacuucgagagcaacgggaacuucaucgcccccgagaacgccuacaagaucgucaagaagggcgacuccaccaucaugaaguccgagcuggaguacggcaacugcaacaccaagugccagaccccgaucggggccaucaacagcagcaugcccuuccacaacauccacccccucacgaucggcgagugccccaaguacgucaagagcaaccggcuggugcuggccaccgggcuccgcaacuccccgcagggcgagcggcgccggaagaagcgcggccuguucggggcgaucgccggcuucaucgagggcggguggcaggggaugguggacggcugguacggcuaccaccacagcaacgagcagggguccggcuacgccgccgacaaggagagcacccagaaggccaucgacggggugaccaacaaggugaacuccaucaucgacaagaugaacacgcaguucgaggcggucggccgggaguucaacaaccuggagcgccggaucgagaaccucaacaagaagauggaggacggguuccuggacguguggaccuacaacgccgagcugcucgugcugauggagaacgagcgcacccuggacuuccacgacagcaacgucaagaaccucuacgacaaggugcggcugcagcugcgcgacaacgccaaggagcucggcaacggcugcuucgaguucuaccaccggugcgacaacgagugcauggaguccguccgcaacgggaccuacgacuacccccaguacagcgaggaggcccgccugaagcgggaggagaucuccggcgugaagcuggagagcaucgggacguaccagauccucuccaucuacagcaccguggccuccagccuggcgcuggccaucauggucgccggccucuuccuguggaugugcuccaacgggagccugcagugccgcaucugcaucuga

SEQ ID NO: 63997 - RNA, 1704 nt, Artificial Sequence
  derived and/or modified sequence opt1 from hemagglutinin__InfluenzaA__ACT15328
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaaggacaacgcguaccccacgaucaagcgcuccuacaacaacaccaaccaggaggaccugcugguccucugggggauccaccaccccaacgacgccgccgagcagacccggcuguaccagaacccgaccacguacaucagcgugggcaccuccacccugaaccagcgccucgugcccaagaucgccacccggagcaaggucaacgggcagaacggccgcauggaguucuucuggacgauccugaaguccaacgacgcgaucaacuucgagagcaacgggaacuucaucgcccccgagaacgccuacaagaucgugaagaagggcgacuccaccaucaugaaguccgagcuggaguacggcaacugcaacaccaagugccagacccccaucggggccaucaacagcuccaugccguuccacaacauccacccccucacgaucggcgagugccccaaguacgucaagagcaaccggcuggugcuggccaccgggcuccgcaacagcccccagggcgagcggcgccggaagaagcgcggccuguucggggcgaucgccggcuucaucgagggcggguggcaggggaugguggacggcugguacggcuaccaccacagcaacgagcagggguccggcuacgccgccgacaaggagagcacccagaaggccaucgacggggugaccaacaaggucaacuccaucaucgacaagaugaacacgcaguucgaggcggugggccgggaguucaacaaccuggagcgccggaucgagaaccucaacaagaagauggaggacggguuccuggacguguggaccuacaacgccgagcugcucguccugauggagaacgagcgcacccuggacuuccacgacagcaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccgcacuacagcgaggaggcccgccugaagcgggaggagaucuccggcgugaagcuggagagcaucgggacguaccagauccucuccaucuacagcaccgucgccuccagccuggcgcuggccaucaugguggccggccucuuccuguggaugugcuccaacgggagccugcagugccgcaucugcaucuga

SEQ ID NO: 63998 - RNA, 1704 nt, Artificial Sequence
  derived and/or modified sequence opt1 from hemagglutinin__InfluenzaA__ACT15330
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaaggacaacgcguaccccacgaucaagcgcuccuacaacaacaccaaccaggaggaccugcugguccucugggggauccaccaccccaacgacgccgccgagcagacccggcuguaccagaacccgaccacguacaucagcgugggcaccuccacccugaaccagcgccucgugcccaagaucgccacccggagcaaggucaacgggcaguccggccgcauggaguucuucuggacgauccucaagagcaacgacgcgaucaacuucgaguccaacgggaacuucaucgcccccgagaacgccuacaagaucgugaagaagggcgacagcaccaucaugaaguccgagcuggaguacggcaacugcaacaccaagugccagacccccaucggggccaucaacagcagcaugccguuccacaacauccacccccugacgaucggcgagugccccaaguacgugaaguccaaccggcugguccuggccaccgggcuccgcaacagcccccagggcgagcggcgccggaagaagcgcggccuguucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacagcaucaucgacaagaugaacacgcaguucgaggcggugggccgggaguucaacaaccuggagcgccggaucgagaaccucaacaagaagauggaggacggguuccuggacguguggaccuacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggaccuacgacuacccgcacuacuccgaggaggcccgccugaagcgggaggagaucagcggcgugaagcuggaguccaucgggacguaccagauccucagcaucuacuccaccgucgccagcucccuggcgcuggccaucaugguggccggccucuuccuguggaugugcagcaacgggucccugcagugccgcaucugcaucuga

SEQ ID NO: 63999 - RNA, 1707 nt, Artificial Sequence
  derived and/or modified sequence opt1 from hemagglutinin__InfluenzaA__ACT15332
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccggggacuucaacgacuacgaggagcucaagcaccuccugucccggaucaaccacuucgagaagauccagaucauccccaagagcuccuggagcgaccacgaggccuccagcggcgucuccagcgccugcccguaccagggccgcuccagcuucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccacaacccgaccaccuacaucagcgugggcacguccacccugaaccagcgccucgugcccaagaucgccacccggagcaagaucaacgggcaguccggccgcauggaguucuucuggaccauccugaagcccaacgacgcgaucaacuucgagagcaacgggaacuucaucgcccccgagaacgccuacaagaucgucaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgucaagagcucccggcuggugcuggccacggggcuccgcaacagcccgcagggcaagucccggcgcaagaagcggggccuguucggggcgaucgccggcuucaucgagggcggguggcaggggaugguggacggcugguacggcuaccaccacagcaacgagcagggguccggcuacgccgccgacaaggagagcacccagcgcgccaucgacggggugaccaacaaggugaacuccaucaucgacaagaugaacacccaguucgaggcggucggccgggaguucaacaaccuggagcgccggaucgagaaccucaacaagaagauggaggacggguuccuggacguguggacguacaacgccgagcugcucgugcugauggagaacgagcgcacccuggacuuccacgacagcaacgucaagaaccucuacgacaaggugcggcugcagcugcgcgacaacgccaaggagcucggcaacggcugcuucgaguucuaccaccggugcgacaacgagugcauggaguccguccgcaacgggaccuacgacuacccccaguacagcgaggaggcccgccugaagcgggaggagaucuccggcgugaagcuggagagcaucgggaucuaccagauccucuccaucuacagcaccguggccuccagccuggcgcuggccaucauggucgccggccucuuccuguggaugugcagcaacgggucccugcagugccgcaucugcaucuga

SEQ ID NO: 64000 - RNA, 1704 nt, Artificial Sequence
  derived and/or modified sequence opt1 from hemagglutinin__InfluenzaA__ACT15336
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaaggacaacgcguaccccacgaucaagcgcuccuacaacaacaccaaccaggaggaccugcugguccucugggggauccaccaccccaacgacgccgccgagcagacccggcuguaccagaacccgaccacguacaucagcgugggcaccuccacccugaaccagcgccucgugcccaagaucgccacccggagcaaggucaacgggcaguccggccgcauggaguucuucuggacgauccucaagagcaacgacgcgaucaacuucgaguccaacgggaacuucaucgcccccgagaacgccuacaagaucgugaagaagggcgacagcaccaucaugaaguccgagcuggaguacggcaacugcaacaccaagugccagacccccaucggggccaucaacagcagcaugccguuccacaacauccacccccugacgaucggcgagugccccaaguacgugaaguccaaccggcugguccuggccaccgggcuccgcaacagcccccagggcgagcggcgccggaagaagcgcggccuguucggggcgaucgccggcuucaucgagggcggguggcaggggaugguggacggcugguacggcuaccaccacuccaacgagcaggggagcggcuacgccgccgacaaggaguccacccagaaggccaucgacggggugaccaacaaggucaacagcaucaucgacaagaugaacacgcaguucgaggcggugggccgggaguucaacaaccuggagcgccggaucgagaaccucaacaagaagauggaggacggguuccuggacguguggaccuacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggaccuacgacuacccgcaguacuccgaggaggcccgccugaagcgggaggagaucagcggcgugaagcuggaguccaucgggacguaccagauccucagcaucuacuccaccgucgccagcucccuggcgcuggccaucaugguggccggccucuuccuguggaugugcagcaacgggucccugcagugccgcaucugcaucuga

SEQ ID NO: 64001 - RNA, 1704 nt, Artificial Sequence
  derived and/or modified sequence opt1 from hemagglutinin__InfluenzaA__ACT15338
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaagaacaacgcguaccccacgaucaagcgcuccuacaacaacaccaaccaggaggaccugcugguccucugggggauccaccaccccaacgacgccaccgagcagacccggcuguaccagaacccgacgaccuacaucagcgugggcaccuccacccugaaccagcgccucauccccaagaucgccacgcggagcaaggugaacgggcaguccggccgcauggaguucuucuggaccauccucaagagcaacgacgccaucaacuucgaguccaacgggaacuucaucgcgcccgagaacgccuacaagaucgucaagaagggcgacagcaccaucaugaaguccgagcuggaguacggcaacugcaacaccaagugccagacgcccaucggggccaucaacagcagcaugccguuccacaacauccacccccugaccaucggcgagugccccaaguacgugaaguccaaccggcuggugcuggccaccgggcuccgcaacagcccccaggagggccggcgccggaagaagcgcggccuguucggggccaucgcgggcuucaucgagggcggguggcaggggauggucgacggcugguacggcuaccaccacuccaacgagcaggggagcggcuacgccgccgacaaggaguccacccagaaggccaucgacggggugacgaacaaggugaacagcaucaucgacaagaugaacacccaguucgaggccgucggccgggaguucaacaaccuggagcgccggaucgagaaccucaacaagaagauggaggacggguuccuggacguguggaccuacaacgcggagcugcucgugcugauggagaacgagcgcacccuggacuuccacgacuccaacgucaagaaccucuacgacaaggugcggcugcagcugcgcgacaacgccaaggagcucggcaacggcugcuucgaguucuaccaccggugcgacaacgagugcauggagagcguccgcaacgggacguacgacuacccgcaguacuccgaggaggcccgccugaagcgggaggagaucagcggcgugaagcuggaguccaucgggaccuaccagauccucagcaucuacuccaccguggccagcucccuggcccuggcgaucauggucgccggccucuuccuguggaugugcagcaacgggucccugcagugccgcaucugcaucuga

SEQ ID NO: 64002 - RNA, 1704 nt, Artificial Sequence
  derived and/or modified sequence opt1 from hemagglutinin__InfluenzaA__ACT15340
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcugaccaagaagaacaacgcguaccccacgaucaagcgcuccuacaacaacaccaaccaggaggaccugcugguccucugggggauccaccaccccaacgacgccgaggagcagacccggcuguaccagaacccgaccacguacaucagcgugggcaccuccacccugaaccagcgccucgugcccaagaucgccacccggagcaaggucaacgggcaguccggccgcauggaguucuucuggacgauccucaagagcaacgacgccaucaacuucgaguccaacgggaacuucaucgcgcccgagaacgccuacaagaucgugaagaagggcgacagcaccaucaugaaguccgagcuggaguacggcaacugcaacaccaagugccagacccccaucggggccaucaacagcagcaugccguuccacaacauccacccccugacgaucggcgagugccccaaguacgugaaguccaaccggcugguccuggccaccgggcuccgcaacagcccccagggcgagcggcgccggaagaagcgcggccuguucggggccaucgcgggcuucaucgagggcggguggcaggggaugguggacggcugguacggcuaccaccacuccaacgagcaggggagcggcuacgccgccgacaaggaguccacccagaaggccaucgacggggugaccaacaaggucaacagcaucaucgacaagaugaacacgcaguucgaggccgugggccgggaguucaacgcgcuggagcgccggaucgagaaccucaacaagaagauggaggacggguuccuggacguguggaccuacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggaccuacgacuacccgcaguacuccgaggaggcccgccugaagcgggaggagaucagcggcgugaagcuggaguccaucgggacguaccagauccucagcaucuacuccaccgucgccagcucccuggcgcuggccaucaugguggccggccucuuccuguggaugugcagcaacgggucccugcagugccgcaucugcaucuga

SEQ ID NO: 64003 - RNA, 1704 nt, Artificial Sequence
  derived and/or modified sequence opt1 from hemagglutinin__InfluenzaA__ACT15342
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccggguccuucaacgacuacgaggagcucaagcaccuccugagccggaucaaccacuucgagaagauccagaucaucccgaagaacuccuggagcgaccacgaggccuccggcgucagcuccgccugccccuaccagggccgcagcuccuucuuccggaacgugguguggcugaccaagaaggacaacgcguaccccacgaucaagcgcagcuacaacaacaccaaccaggaggaccugcugguccucugggggauccaccaccccaacgacgccgccgagcagacccggcuguaccagaacccgaccacguacaucuccgugggcaccagcacccugaaccagcgccucgugcccaagaucgccacccgguccaaggucaacgggcagagcggccgcauggaguucuucuggacgauccugaagcccaacgacgcgaucaacuucgaguccaacgggaacuucaucgcccccgagaacgccuacaagaucgugaagaagggcgacagcaccaucaugaaguccgagcuggaguacggcaacugcaacaccaagugccagaccccgaucggggccaucaacagcagcaugcccuuccacaacauccacccccucacgaucggcgagugccccaaguacgugaaguccaaccggcugauccuggccaccgggcuccgcaacagcccgcagggcgagcggcgccggaagaagcgcggccuguucggggcgaucgccggcuucaucgagggcggguggcaggggauggucgacggcugguacggcuaccaccacuccaacgagcaggggagcggcuacgccgccgacaaggaguccacccagaaggccaucgacggggugaccaacaaggugaacagcaucaucgacaagaugaacacgcaguucgaggcggucggccgggaguucaacaaccuggagcgccggaucgagaaccucaacaagaagauggaggacggguuccuggacguguggaccuacaacgccgagcugcucgugcugauggagaacgagcgcacccuggacuuccacgacuccaacgucaagaaccucuacgacaaggugcggcugcagcugcgcgacaacgccaaggagcucggcaacggcugcuucgaguucuaccaccggugcgacaacgagugcauggagagcguccgcaacgggaccuacgacuacccccaguacuccgaggaggcccgccugaagcgggaggagaucagcggcgugaagcuggaguccaucgggacguaccagauccucagcaucuacuccaccguggccagcucccuggcgcuggccaucauggucgccggccucuuccuguggaugugcagcaacgggucccugcagugccgcaucugcaucuga

SEQ ID NO: 64004 - RNA, 1704 nt, Artificial Sequence; identical to SEQ ID NO: 64000
  derived and/or modified sequence opt1 from hemagglutinin__InfluenzaA__ACT15343

SEQ ID NO: 64005 - RNA, 1704 nt, Artificial Sequence
  derived and/or modified sequence opt1 from hemagglutinin__InfluenzaA__ACT15345
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacgaggccagcggcgucuccagcuccugccccuaccagggccgcagcuccuucuuccggaacgugguguggcucaccaagaaggacaacgccuaccccacgaucaagcgcagcuacaacaacaccaaccaggaggaccugcugguccucugggggauccaccaccccaacgacgcggccgagcagacccggcuguaccagaacccgaccacguacaucuccgugggcaccagcacccugaaccagcgccucgugcccaagaucgccacccgguccaaggucaacgggcagagcggccgcauggaguucuucuggacgauccugaaguccaacgacgccaucaacuucgggagcaacggcaacuucaucgcgcccgagaacgccuacaagaucgugaagaagggcgacagcaccaucaugaaguccgagcuggaguacgggaacugcaacaccaagugccagacccccaucggcgccaucaacagcuccaugccguuccacaacauccacccccucacgaucggggagugccccaaguacgugaaguccaaccggcugguccuggccaccggccuccgcaacagcccccagggcgagcggcgccggaagaagcgcgggcuguucggcgccaucgcgggguucaucgagggcggguggcagggcaugguggacggcugguacggguaccaccacagcaacgagcagggcuccggguacgccgccgacaaggagagcacccagaaggccaucgacggcgugaccaacaaggucaacuccaucaucgacaagaugaacacgcaguucgaggccguggggcgggaguucaacaaccuggagcgccggaucgagaaccucaacaagaagauggaggacggcuuccuggacguguggaccuacaacgcggagcugcucguccugauggagaacgagcgcacccuggacuuccacgacagcaacgugaagaaccucuacgacaagguccggcugcagcugcgcgacaacgccaaggagcucggcaacgggugcuucgaguucuaccaccggugcgacaacgagugcauggaguccgugcgcaacggcaccuacgacuacccgcaguacagcgaggaggcccgccugaagcgggaggagaucuccggggugaagcuggagagcaucggcacguaccagauccucuccaucuacagcaccgucgccuccagccuggcccuggcgaucaugguggccgggcuguuccuguggaugugcuccaacggcagccugcagugccgcaucugcaucuga

SEQ ID NO: 64006 - RNA, 1707 nt, Artificial Sequence
  derived and/or modified sequence opt1 from hemagglutinin__InfluenzaA__ACT15347
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccggggacuucaacgacuacgaggagcucaagcaccuccugucccggaucaaccacuucgagaagauccagaucauccccaagagcuccuggagcgaccacgaggccuccagcggcgucuccagcgccugcccguaccagggccgcuccagcuucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccacaacccgaccaccuacaucagcgugggcacguccacccugaaccagcgccucgugcccaagaucgccacccggagcaaggucaacgggcaguccggccgcauggaguucuucuggaccauccugaagcccaacgacgcgaucaacuucgagagcaacgggaacuucaucgcccccgagaacgccuacaagaucgugaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgucaagagcucccggcuggugcuggccacggggcuccgcaacagcccgcagggcaagaaccggcgcaagaagcggggccuguucggggcgaucgccggcuucaucgagggcggguggcaggggaugguggacggcugguacggcuaccaccacuccaacgagcaggggagcggcuacgccgccgacaaggaguccacccagcgcgccaucgacggggugaccaacaaggucaacagcaucaucgacaagaugaacacccaguucgaggcggugggccgggaguucaacaaccuggagcgccggaucgagaaccucaacaagaagauggaggacggguuccuggacguguggacguacaacgccgagcugcucguccugauggagaacgagcgcacccuggacuuccacgacuccaacgugaagaaccucuacgacaagguccggcugcagcugcgcgacaacgccaaggagcucggcaacggcugcuucgaguucuaccaccggugcgacaacgagugcauggagagcgugcgcaacgggaccuacgacuacccccaguacuccgaggaggcccgccugaagcgggaggagaucagcggcgugaagcuggaguccaucgggaucuaccagauccucagcaucuacuccaccgucgccagcucccuggcgcuggccaucaugguggccggccucuuccuguggaugugcagcaacgggagccugcagugccgcaucugcaucuga

SEQ ID NO: 64007 - RNA, 1704 nt, Artificial Sequence
  derived and/or modified sequence opt1 from hemagglutinin__InfluenzaA__ACT15349
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcucaccaagaaggacaacgcguaccccacgaucaagcgcuccuacaacaacaccaaccaggaggaccugcugguccucugggggauccaccaccccaacgacgccaccgagcagacccggcuguaccagaacccgacgaccuacaucagcgugggcaccuccacccugaaccagcgccucauccccaagaucgccacgcggagcaaggugaacgggcaguccggccgcauggaguucuucuggaccauccucaagagcaacgacgccaucaacuucgaguccaacgggaacuucaucgcgcccgagaacgccuacaagaucgucaagaagggcgacagcaccaucaugaaguccgagcuggaguacggcaacugcaacaccaagugccagacgcccaucggggccaucaacagcagcaugccguuccacaacauccacccccugaccaucggcgagugccccaaguacgugaaguccaaccggcuggugcuggccaccgggcuccgcaacagcccccaggaggagcggcgccggaagaagcgcggccuguucggcgccaucgcgggguucaucgagggcggguggcagggcauggucgacgggugguacggcuaccaccacuccaacgagcagggcagcggguacgccgccgacaaggaguccacccagaaggccaucgacggcgugacgaacaaggugaacagcaucaucgacaagaugaacacccaguucgaggccgucgggcgggaguucaacaaccuggagcgccggaucgagaaccucaacaagaagauggaggacggcuuccuggacguguggaccuacaacgcggagcugcucgugcugauggagaacgagcgcacccuggacuuccacgacuccaacgucaagaaccucuacgacaaggugcggcugcagcugcgcgacaacgccaaggagcucgggaacggcugcuucgaguucuaccaccggugcgacaacgagugcauggagagcguccgcaacggcacguacgacuacccgcaguacuccgaggaggcccgccugaagcgggaggagaucagcggggugaagcuggaguccaucggcaccuaccagauccucagcaucuacuccaccguggccagcucccuggcccuggcgaucauggucgccgggcuguuccuguggaugugcagcaacggcucccugcagugccgcaucugcaucuga

SEQ ID NO: 64008 - RNA, 1707 nt, Artificial Sequence
  derived and/or modified sequence opt1 from hemagglutinin__InfluenzaA__ACT15351
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccggggacuucaacgacuacgaggagcucaagcaccuccugucccggaucaaccacuucgagaagauccagaucauccccaagagcuccuggagcgaccacgaggccuccagcggcgucuccagcgccugcccguaccagggcggguccagcuucuuccgcaacgugguguggcucaucaagaaggacaacgcguaccccaccaucaagcgguccuacaacaacacgaaccaggaggaccugcugguccucuggggcauccaccaccccaacgacgccgccgagcagacccgccuguaccacaacccgaccaccuacaucagcguggggacguccacccugaaccagcggcucgugcccaagaucgccacccgcagcaaggucaacggccaguccgggcggauggaguucuucuggaccauccugaagcccaacgacgcgaucaacuucgagagcaacggcaacuucaucgcccccgagaacgccuacaagaucgugaagaagggcgacagcacgaucaugaaguccgagcuggaguacgggaacugcaacaccaagugccagaccccgaucggcgccaucaacagcuccaugcccuuccacaacauccacccccucaccaucggggagugccccaaguacgucaagagcucccgccuggugcuggccacgggccuccggaacagcccgcagggcaagucccgccggaagaagcgcgggcuguucggcgcgaucgccggguucaucgagggcggguggcagggcaugguggacggcugguacggguaccaccacagcaacgagcagggcuccggguacgccgccgacaaggagagcacccagcgggccaucgacggcgugaccaacaaggucaacuccaucaucgacaagaugaacacccaguucgaggcgguggggcgcgaguucaacaagcuggagcggcgcaucgagaaccucaacaagaagauggaggacggcuuccuggacguguggacguacaacgccgagcugcucguccugauggagaacgagcggacccuggacuuccacgacagcaacgugaagaaccucuacgacaagguccgccugcagcugcgggacaacgccaaggagcucggcaacgggugcuucgaguucuaccaccgcugcgacaacgagugcauggaguccgugcggaacggcaccuacgacuacccccaguacagcgaggaggcccgccugaagcgcgaggagaucuccggggugaagcuggagagcaucggcaucuaccagauccucuccaucuacagcaccgucgccuccagccuggcgcuggccaucaugguggccgggcuguuccuguggaugugcagcaacggcucccugcagugccggaucugcaucuga

SEQ ID NO: 64009 - RNA, 1704 nt, Artificial Sequence
  derived and/or modified sequence opt1 from hemagglutinin__InfluenzaA__ACT15353
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcaaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccggaucaaccacuucgagaagauccagaucaucccgaagaacagcugguccgaccacgaggccagcggcgucuccagcgccugccccuaccagggccgcuccagcuucuuccggaacgugguguggcucaccaagaagaacuccgcguaccccacgaucaagcgcagcuacaacaacaccaaccaggaggaccugcugguccucugggggauccaccaccccaacgacgccgccgagcagacccggcuguaccagaacccgaccacguacaucuccgugggcaccagcacccugaaccagcgccucgugcccaagaucgccacccgguccaaggucaacgggcagagcggccgcauggaguucuucuggacgauccugaaguccaacgacgcgaucaacuucgagagcaacgggaacuucaucgcccccgagaacgccuacaagaucgugaagaagggcgacagcaccaucaugaaguccgagcuggaguacagcaacugcaacaccaagugccagacccccaucggcgccaucaacuccagcaugccguuccacaacauccacccccucacgaucggggagugccccaaguacgugaaguccaaccggcugguccuggccaccggccuccgcaacagcccccagggggagcggcgccggaagaagcgcggccuguucggcgcgaucgccggguucaucgagggcggguggcagggcaugguggacgggugguacggcuaccaccacuccaacgagcagggcagcggguacgccgccgacaaggaguccacccagaaggccaucgacggcgugaccaacaaggucaacagcaucaucgacaagaugaacacgcaguucgaggcgguggggcgggaguucaacaaccuggagcgccggaucgagaaccucaacaagaagauggaggacggcuuccuggacguguggaccuacaacgccgagcugcucguccugauggagaacgagcgcacccuggacuuccacgacuccaacgugaagaaccucuacgacaagguccggcugcagcugcgcgacaacgccaaggagcucgggaacggcugcuucgaguucuaccaccggugcgacaacgagugcauggagagcgugcgcaacggcaccuacgacuacccgcaguacuccgaggaggcccgccugaagcgggaggagaucagcggggugaagcuggaguccaucggcacguaccagauccucagcaucuacuccaccgucgccagcucccuggcgcuggccaucaugguggccgggcuguuccuguggaugugcagcaacggcagccugcagugccgcaucugcaucuga

SEQ ID NO: 64010 - RNA, 1707 nt, Artificial Sequence
  derived and/or modified sequence opt1 from hemagglutinin__InfluenzaA__ACT15355
auggagaagaucgugcugcuccuggccaucgucagccuggugaaguccgaccagaucugcaucggcuaccacgccaacaacagcaccgagcaggucgacaccaucauggagaagaacgugacggugacccacgcgcaggacauccucgagaagacccacaacgggaagcugugcgaccuggacggcgugaagccccucauccugcgcgacugcuccgucgccggguggcugcucggcaacccgaugugcgacgaguuccugaacgugcccgaguggagcuacaucguggagaagaucaaccccgccaacgaccugugcuaccccggggacuucaacgacuacgaggagcucaagcaccuccugucccggaucaaccacuucgagaagauccagaucauccccaagagcuccuggagcgaccacgaggccuccagcggcgucuccagcgccugcccguaccagggccgcuccagcuucuuccggaacgugguguggcugaucaagaaggacaacgcguaccccaccaucaagcgcuccuacaacaacacgaaccaggaggaccugcugguccucugggggauccaccaccccaacgacgccgccgagcagacccggcuguaccacaacccgaccaccuacaucagcgugggcacguccacccugaaccagcgccucgugcccaagaucgccacccggagcaaggucaacgggcaguccggccgcauggaguucuucuggaccauccugaagcccaacgacgcgaucaacuucgagagcaacgggaacuucaucgcccccgagaacgccuacaagaucgugaagaagggcgacagcacgaucaugaaguccgagcuggaguacggcaacugcaacaccaagugccagaccccgaucggggccaucaacagcuccaugcccuuccacaacauccacccccucaccaucggcgagugccccaaguacgucaagagcucccggcuggugcuggccacggggcuccgcaacagcccgcagggcaagucccggcgcaagaagcggggccuguucggggcgaucgccggcuucaucgagggcggguggcaggggaugguggacggcugguacggcuaccaccacagcaacgagcagggguccggcuacgccgccgacaaggagagcacccagcgcgccaucgacggggugaccaacaaggucaacuccaucaucgacaagaugaacacccaguucgaggcggugggccgggaguucaacaaccuggagcgccggaucgagaaccucaacaagaagauggaggacggguuccuggacguguggacguacaacgccgagcugcucguccugauggagaacgagcgcacccuggacuuccacgacagcaacgugaagaaccucuacgacaagguccggcugcagcugcgcgacaacgccaaggagcucggcaacggcugcuucgaguucuaccaccggugcgacaacgagugcauggaguccgugcgcaacgggaccuacgacuacccccaguacagcgaggaggcccgccugaagcgggaggagaucuccggcgugaagcuggagagcaucgggaucuaccagauccucuccaucuacagcaccgucgccuccagccuggcgcuggccaucaugguggccggccucuuccuguggaugugcagcaacgggucccugcagugccgcaucugcaucuga

SEQ ID NO: 64011 - RNA, 1704 nt, Artificial Sequence
  derived and/or modified sequence opt1 from hemagglutinin__InfluenzaA__ACT15357
auggagaagaucgugcugcuccuggccaucgucagccuggugaaguccgaccagaucugcaucggcuaccacgccaacaacagcaccgagcaggucgacaccaucauggagcgcaacgugacggugacccacgcgcaggacauccucgagaagacccacaacgggaagcugugcaaccuggacggcgugaagccccucauccugcgggacugcuccgucgccggguggcugcucggcaacccgaugugcgacgaguuccugaacgugcccgaguggagcuacaucguggagaagaucaaccccgccaacgaccugugcuaccccgggaacuucaacgacuacgaggagcucaagcaccuccugucccgcaucaaccacuucgagaagauccagaucaucccgaagaacagcugguccgaccacgaggccagcggcgucuccagcgccugccccuaccagggccgguccagcuucuuccgcaacgugguguggcugacccagaaggacaacgcguaccccacgaucaagcgguccuacaacaacaccaaccaggaggaccugcugguccucugggggauccaccaccccaacgacgccgccgagcagacccgccuguaccagaacccgaccacguacaucagcgugggcaccuccacccugaaccagcggcucauccccaagaucgccacccgcagcaaggugaacgggcaguccggccggauggaguucuucuggacgauccucaagagcaacgacgcgaucaacuucgaguccaacgggaacuucaucgcccccgagaacgccuacaagaucgucaagaagggcgacagcaccaucaugaaguccgagcuggaguacggcaacugcaacaccaagugccagacccccaucggggccaucaacagcagcaugccguuccacaacauccacccccugacgaucggcgagugccccaaguacgugaaguccaaccgccuggugcuggccaccgggcuccggaacagcccccagggcgagcgccggcgcaagaagcggggccuguucggggcgaucgccggcuucaucgagggcggguggcaggggauggucgacggcugguacggcuaccaccacuccaacgagcaggggagcggcuacgccgccgacaaggaguccacccagaaggccaucgacggggugaccaacaaggugaacagcaucaucgacaagaugaacacgcaguucgaggcggucggccgcgaguucaacaaccuggagcggcgcaucgagaaccucaacaagaagauggaggacggguuccuggacguguggaccuacaacgccgagcugcucgugcugauggagaacgagcggacccuggacuuccacgacuccaacgucaagaaccucuacgacaaggugcgccugcagcugcgggacaacgccaaggagcucggcaacggcugcuucgaguucuaccaccgcugcgacaacgagugcauggagagcguccgcaacgggaccuacgacuacccgcaguacuccgaggaggcccggcugaagcgcgaggagaucagcggcgugaagcuggaguccaucgggacguaccagauccucagcaucuacuccaccguggccagcucccuggcgcuggccaucauggucgccggccucuuccuguggaugugcagcaacgggucccugcagugccggaucugcaucuga

SEQ ID NO: 64012 - RNA, 1701 nt, Artificial Sequence
  derived and/or modified sequence opt1 from hemagglutinin__InfluenzaA__ACT20200
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64013 - RNA, 1701 nt, Artificial Sequence
  derived and/or modified sequence opt1 from hemagglutinin__InfluenzaA__ACT21466
augaagaccaucaucgcccugagcuacauccucugccugguguucgcccagaagcugcccggcaacgacaacuccaccgcgacgccgugccucgggcaccacgccguccccaacggcacccuggugaagaccaucaccaacgaccagaucgaggugacgaacgccaccgagcugguccagagcuccagcaccgggaagaucugcgacagcccccaccgcauccucgacggcaagaacugcacccugaucgacgcccugcucggggacccccacugcgacggcuucaagaacaaggagugggaccuguucguggagcggagcacggccuacuccaacugcuacccguacgacgugcccgacuacgcgagccugcgcucccucgucgccagcuccggcacccuggaguucaccaacgagggguucaacuggaccggcguggcccaggacgggacgagcuacgccugcaagcggggcuccgugaaguccuucuucucccgccugaacuggcuccacaagcuggaguacaaguaccccgcgcugaacgucaccaugcccaacaacgacaaguucgacaagcucuacaucuggggcgugcaccacccgagcaccgacuccgaccagaccagccuguacgugcaggccuccgggcgggucacggugagcaccaagcgcagccagcagaccgugauccccaacaucggcucccggcccuggguccgcgggaucagcucccggaucagcaucuacuggaccaucgugaagcccggcgacauccugcucaucaacuccacggggaaccugaucgccccgcgcggcuacuucaagauccggagcggcaaguccagcaucaugcgcuccgacgcccccaucgacaacugcaacagcgagugcaucacccccaacggguccauccccaacgacaagccguuccagaacgugaaccggaucaccuacggcgccugcccccgcuacgucaagcagaacacccugaagcucgcgacggggaugcggaacgugcccgagaagcagacccgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcugaaccgccucaucgagaagacgaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucaccgacagcgagaugaacaagcuguucgagaagacgcgcaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcucaagagcggcuacaaggacuggauccuguggaucuccuucgccaucagcugcuuccugcugugcgucgugcugcucggcuucaucaugugggccugccagaaggggaacauccgcugcaacaucugcaucuga

SEQ ID NO: 64014 - RNA, 1701 nt, Artificial Sequence
  derived and/or modified sequence opt1 from hemagglutinin__InfluenzaA__ACT21467
augaagaccaucaucgcccugagcuacauccucugccugguguucgcccagaagcugcccggcuccgacaacagcaccgcgacgcucugccuggggcaccacgccgucccgaacggcacccuggugaagaccaucaccaacgaccagaucgaggugacgaacgccaccgagcucguccaguccagcuccaccgggaagaucugcgacagcccccaccgcauccuggacggcaagaacugcacccugaucgacgcccuccugggggacccccacugcgacggcuucaagaacaaggagugggaccuguucguggagcgguccacggccuacagcaacugcuaccccuacgacgugccggacuacgcgucccuccgcagccuggucgccuccagcggcacccuggaguucaccaacgagggguucaacuggaccggcguggcccaggacgggacguccuacgccugcaagcggggcagcgugaaguccuucuucagccgccucaacuggcugcacaagcuggaguacaaguaccccgcgcucaacgucaccaugcccaacaacgacaaguucgacaagcuguacaucuggggcgugcaccaccccuccaccgacagcgaccagaccucccuguacgugcaggccagcgggcgggucacggugagcaccaagcgcucccagcagaccgugaucccgaacaucggcagccggcccuggguccgcgggaucuccagccggaucuccguguacuggaccaucgugaagccccgcgacauccuccugaucaacagcacgggcaaccugaucgcgccccggggguacuucaagauccgcuccggcaagagcuccaucaugcggagcgacgccccgaucgacaacugcaacuccgagugcaucacccccaacggcagcauccccaacgacaagcccuuccagaacgucaaccgcaucaccuacggggccugcccgcgguacgugaagcagaacacccucaagcuggccacgggcaugcgcaacgugcccgagaagcagacccgggggaucuucggcgccaucgccggguucaucgagaacggcugggagggcauggucgacgggugguacggcuuccgccaccagaacuccgaggggaccggccaggccgccgaccucaagagcacccaggcggccaucaaccggaucaacgggaagcugaaccgccugaucgagaagacgaacgagaaguuccaccagaucgagaaggaguucuccgagguggagggccggauccaggaccuggagaaguacguggaggacaccaagaucgaccucuggagcuacaacgccgagcugcuggucgcccucgagaaccagcacaccaucgaccugaccgacuccgagaugaacaagcuguucgagaagacgcgcaagcagcuccgcgagaacgccgaggacaugggcaacgggugcuucaagaucuaccacaagugcgacaacgcgugcaucggcagcauccggaacgggaccuacgaccacgacguguaccgcgacgaggcccugaacaaccgguuccagaucaagggcgucgagcugaaguccggguacaaggacuggauccucuggaucagcuucgccaucagcugcuuccugcugugcguggugcuccugggcuucaucaugugggccugccagaagggcaacauccgcugcaacaucugcaucuga

SEQ ID NO: 64015 - RNA, 1701 nt, Artificial Sequence
  derived and/or modified sequence opt1 from hemagglutinin__InfluenzaA__ACT21468
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggaagaucugcgacagcccccaccgcauccuggacggcaagaacugcacccugaucgacgcccuccugggggacccccacugcgacggcuucaagaacaaggagugggaccuguucguggagcggagcacggccuacuccaacugcuaccccuacgacgugccggacuacgcgagccuccgcucccuggucgccagcuccggcacccuggaguucaccaacgagggguucaacuggaccggcguggcccaggacgggacgagcuacgccugcaagcggggcuccgugaaguccuucuucucccgccucaacuggcugcacaagcuggaguacaaguaccccgcgcucaacgucaccaugcccaacaacgacaaguucgacaagcuguacaucuggggcgugcaccaccccagcaccgacuccgaccagaccagccuguacgugcaggccuccgggcgggucacggugagcaccaagcgcagccagcagaccgugaucccgaacaucggcucccggcccuggguccgcgggaucagcucccggaucagcaucuacuggaccaucgugaagcccggcgacauccuccugaucaacuccacggggaaccugaucgcgccccgcggcuacuucaagauccggagcggcaaguccagcaucaugcgcuccgacgccccgaucgacaacugcaacagcgagugcaucacccccaacggguccauccccaacgacaagcccuuccagaacgugaaccggaucaccuacggcgccugcccgcgcuacgucaagcagaacacccucaagcuggccacggggaugcggaacgugcccgagaagcagacccgcggcaucuucggggccaucgccggcuucaucgagaacggcugggaggggaugguggacggcugguacggguuccggcaccagaacagcgagggcaccgggcaggccgccgaccugaaguccacccaggcggccaucaaccagaucaacggcaagcucaaccgccugaucgagaagacgaacgagaaguuccaccagaucgagaaggaguucagcgaggucgagggccggauccaggaccuggagaaguacguggaggacaccaagaucgaccucugguccuacaacgccgagcugcugguggcccucgagaaccagcacaccaucgaccugaccgacagcgagaugaacaagcuguucgagaagacgcgcaagcagcuccgggagaacgucgaggacauggggaacggcugcuucaagaucuaccacaagugcgacaacgccugcaucggguccauccgcaacggcaccuacgaccacgacguguaccgcgacgaggcgcugaacaaccgguuccagaucaagggggucgagcucaagagcggcuacaaggacuggauccuguggaucuccuucgccaucagcugcuuccugcugugcguggugcuccugggcuucaucaugugggccugccagaaggggaacauccgcugcaacaucugcaucuga

SEQ ID NO: 64016 - RNA, 1701 nt, Artificial Sequence
  derived and/or modified sequence opt1 from hemagglutinin__InfluenzaA__ACT21469
augaagaccaucaucgcccugagcuacaucucccgccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcggaucugcgacagcccccaccgcauccucgacggcgagaacugcacccugaucgacgcccugcucggggacccccacugcgacggcuuccagaacaaggagugggaccuguucguggagcgguccaaggccuacagcaacugcuaccccuacgacgugccggacuacgcgucccugcgcagccucgucgccuccagcggcacgcuggaguucaacaacgaguccuucaacuggaccgggguggcccaggacggcaccagcuacgccugcaagcggcgcuccaucaagagcuucuucucccggcugaacuggcuccaccagcugaaguacaaguaccccgcgcugaacgugaccaugcccaacaacgacaaguucgacaagcucuacaucuggggcguccaccaccccagcacggacuccgaccagaccagccuguacgcccaggccagcgggcgcgugaccguguccaccaagcggagccagcagacggucaucccgaacaucgggucccgccccugggugcggggcgugagcucccgcaucagcaucuacuggaccaucgucaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucacguacggggccugcccgcgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggacgggccaggccgcggaccugaaguccacccaggccgccaucaaccagaucaacgggaagcugaaccggcucaucgagaagaccaacgagaaguuccaccagaucgagaaggaguucagcgagguggagggccgcauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccggaagcagcugcgcgagaacgcggaggacaugggcaacgggugcuucaagaucuaccacaagugcgacaacgccugcaucggcuccauccggaacgggaccuacgaccacgacguguaccgcgacgaggcccucaacaaccgguuccagaucaagggcgucgagcucaagagcggguacaaggacuggauccuguggaucagcuucgccaucuccugcuuccugcugugcgugguccugcucggcuucaucaugugggccugccagaagggcaacauccgcugcaacaucugcaucuga

SEQ ID NO: 64017 - RNA, 1701 nt, Artificial Sequence
  derived and/or modified sequence opt1 from hemagglutinin__InfluenzaA__ACT21471
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaacaacgaguccuucaacuggaccgggguggcccaggacggcaccagcuacgccugcaagcgccgguccaucaagagcuucuucucccgccugaacuggcuccaccagcugaaguacaaguaccccgcgcugaacgugaccaugcccaacaacgacaaguucgacaagcucuacaucuggggcguccaccaccccagcacggacuccgaccagaccagccuguacgcccaggccagcgggcgggugaccguguccaccaagcgcagccagcagacggucaucccgaacaucgggucccggcccugggugcgcggcgugagcucccggaucagcaucuacuggaccaucgucaagcccggcgacauccugcucaucaacuccaccgggaaccugaucgcgccccgcggcuacuucaagauccggagcgggaaguccagcaucaugcgcuccgacgccccgaucggcaagugcaacagcgagugcaucacccccaacggcuccauccccaacgacaagcccuuccagaacgugaaccggaucacguacggggccugcccgcgcuacgugaagcagaacacccugaagcucgccaccggcaugcggaacguccccgagaagcagacccgcgggaucuucggcgccaucgccggguucaucgagaacggcugggagggcaugguggacgggugguacggcuuccggcaccagaacagcgaggggacgggccaggccgcggaccugaaguccacccaggccgccaucaaccagaucaacgggaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagcgcacccgcaagcagcugcgggagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcucaagagcggguacaaggacuggauccuguggaucagcuucgccaucuccugcuuccugcugugcgugguccugcucggcuucaucaugugggccugccagaagggcaacauccggugcaacaucugcaucuga

SEQ ID NO: 64018 - RNA, 1701 nt, Artificial Sequence
  derived and/or modified sequence opt1 from hemagglutinin__InfluenzaA__ACT21472
augaagaccaucaucgcccugagcuacaucuccugccucguguucgcccagaagcugcccggcaacgacaacagcaccgcgacgcugugccucgggcaccacgccgucccgaacggcacccuggugaagaccaucaccaacgaccagaucgaggugacgaacgccaccgagcugguccaguccagcuccaccgggcgcaucugcgacagcccccaccggauccucgacggcgagaacugcacccugaucgacgcccugcucggggacccccacugcgacggcuuccagaacaaggagugggaccuguucguggagcgcuccaaggccuacagcaacugcuaccccuacgacgugccggacuacgcgucccugcggagccucgucgccuccagcggcacgcuggaguucaacaacgaguccuucaacuggaccgggguggcccaggacggcaccagcuacgccugcaagcgccgguccaucaagagcuucuucuccacccugaacuggcuccaccagcugaaguacaaguaccccgcgcugaacgugacgaugcccaacaacgacaaguucgacaagcucuacaucuggggcguccaccaccccagcaccgacuccgaccagaccagccuguacgcccaggccagcgggcgcgugaccguguccacgaagcggagccagcagaccgucaucccgaacaucgggucccgccccugggugcggggcgugagcucccgcaucagcaucuacuggaccaucgucaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacgcccaacggcuccauccccaacgacaagcccuuccagaacgugaaccgcaucaccuacggggccugcccgcgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggaccggccaggccgcggaccugaaguccacccaggccgccaucaaccagaucaacgggaagcugaaccggcucaucgagaagaccaacgagaaguuccaccagaucgagaaggaguucagcgagguggagggccgcauccaggaccuggagaaguacgucgaggacacgaagaucgaccugugguccuacaacgccgagcuccugguggcccuggagaaccagcacaccaucgaccucaccgacagcgagaugaacaagcuguucgagcggacccgcaagcagcugcgcgagaacgcggaggacaugggcaacgggugcuucaagaucuaccacaagugcgacaacgccugcaucggcuccauccggaacgggacguacgaccacgacguguaccgcgacgaggcccucaacaaccgguuccagaucaagggcgucgagcucaagagcggguacaaggacuggauccuguggaucagcuucgccaucuccugcuuccugcugugcgugguccugcucggcuucaucaugugggccugccagaagggcaacauccgcugcaacaucugcaucuga

SEQ ID NO: 64019 - RNA, 1701 nt, Artificial Sequence
  derived and/or modified sequence opt1 from hemagglutinin__InfluenzaA__ACT21507
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaaccgcacccugaucgacgcccugcucggcgacccccagugcgacggcuuccagaacaagaagugggaccuguucguggagcggagcaaggccuacuccaacugcuaccccuacgacgugccggacuacgcgagccugcgcucccucgucgccagcuccgggacgcuggaguucaacaacgagagcuucaacuggaccggcgugacccagaacgggaccuccagcgccugcaagggccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucgggucccggccccgcguccgggacauccccagccgcaucuccaucuacuggaccaucgugaagcccggcgacauccugcucaucaacagcaccgggaaccugaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggcuucaucgagaacgggugggagggcaugguggacgggugguacggcuuccgccaccagaacuccgaggggaucggccaggccgccgaccugaaguccacccaggcggccaucaaccagaucaacggcaagcugaaccggcucaucgggaagaccaacgagaaguuccaccagaucgagaaggaguucuccgaggucgagggccgcauccaggaccuggagaaguacguggaggacacccggaucgaccuguggagcuacaacgccgagcuccugguggcccuggagucccagcacacgaucgaccucaccgacagcgagaugaacaagcuguucgagcgcaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaagcgguuccagaucaagggcguggagcucaagagcggguacaaggacuggauccuguggaucuccuucgccaucagcugcuuccugcugugcguggcccugcucggcuucaucaugugggccugccagaaggggaacauccgcugcaacaucugcaucuga

SEQ ID NO: 64020 - RNA, 1701 nt, Artificial Sequence
  derived and/or modified sequence opt1 from hemagglutinin__InfluenzaA__ACT21508
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcaggacacccugaagcucgcgaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccugaaguccacccaggcggccaucaaccagaucaacggcaagcugaaccggcucaucggcaagaccaacgagaaguuccaccagaucgagaaggaguucuccgaggucgaggggcgcauccaggaccuggagaaguacguggaggacaccaagaucgaccuguggagcuacaacgccgagcuccugguggcccuggagaaccagcacacgaucgaccucaccgacuccgagaugaacaagcuguucgagcggaccaagaagcagcugcgcgagaacgccgaggacaugggcaacgggugcuucaagaucuaccacaagugcgacaacgcgugcaucggcagcauccgcaacgggaccuacgaccacgacgucuaccgggacgaggcccucaacaaccgcuuccagaucaagggcguggagcugaaguccggcuacaaggacuggauccuguggaucagcuucgccaucuccugcuuccuccugugcguggcccugcucggguucaucaugugggccugccagaagggcaacauccggugcaacaucugcaucuga

SEQ ID NO: 64021 - RNA, 1701 nt, Artificial Sequence
  derived and/or modified sequence opt1 from hemagglutinin__InfluenzaA__ACT21509
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcuccaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucagccuguacgcgcaggccuccggccggaucaccgugagcacgaagcgcagccagcagaccgugaucccgaacaucggcucccggccccgcguccgggacauccccagccgcaucuccaucuacuggaccaucgugaagcccggggacauccugcucaucaacagcaccggcaaccugaucgccccgcggggguacuucaagauccgcuccggcaagagcuccaucaugcggagcgacgcccccaucggcaagugcaacuccgagugcaucacgcccaacgggagcauccccaacgacaagccguuccagaacgugaaccgcaucaccuacggcgccugcccccgguacgucaagcagaacacccugaagcucgcgaccgggaugcgcaacgugcccgagacgcagacccggggcaucuucggggccaucgccggcuucaucgagaacggcugggaggggaugguggacggcugguacggguuccgccaccagaacuccgagggcaccgggcaggccgccgaccucaagagcacccaggcggccaucaaccagaucaacggcaagcccaaccggcugaucggcaagacgaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacaccaucgaccugaccgacuccgagaugaacaagcuguucgagaagacgaagaagcagcugcgggagaacgccgaggacaugggcaacgggugcuucaagaucuaccacaagugcgacaacgcgugcaucggcagcauccgcaacgagaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 64022 - RNA, 1701 nt, Artificial Sequence
  derived and/or modified sequence opt1 from hemagglutinin__InfluenzaA__ACT21510
augaagaccaucaucgcccugagcuacauccucugccccguguucgcccagaagcugccgggcaacgacaacuccaccgcgacgcugugccucgggcaccacgccguccccaacggcaccaucgugaagaccaucaccaacgaccagaucgaggugacgaacgccaccgagcugguccagagcuccagcaccgggggcaucugcgacagcccccaccagauccuggacggggagaacugcacccucaucgacgcccugcugggcgacccccagugcgacggcuuccagaacaagaagugggaccucuucguggagcgcuccaaggccuacuccaacugcuacccguacgacgugcccgacuacgcgagccugcggucccuggucgccagcuccgggacgcucgaguucaacaacgagagcuucaacuggaccggcgugacccagaacgggaccuccagcgccugcaagcgccgguccaacaacagcuucuucucccgccugaacuggcugacgcaccucaaguucaaguaccccgcccugaacgugaccaugcccaacaacgagaaguucgacaagcuguacaucuggggcguccaccacccggggaccgacaacgaccagaucagccucuacgcgcaggccuccggccggaucaccgugagcacgaagcgcagccagcagaccgugauccccaacaucggcucccggccccgcguccgggacauccccagccgcaucuccaucuacuggaccaucgugaagccgggggacauccugcugaucaacagcaccggcaaccucaucgcgccccggggguacuucaagauccgcuccggcaagagcuccaucaugcggagcgacgcccccaucggcaagugcaacuccgagugcaucacgcccaacgggagcaucccgaacgacaagcccuuccaggacgugaaccgcaucaccuacggcgccugcccccgguacgucaagcagaacacccugaagcuggccaccgggaugcgcaacgugcccgagaagcagacgcggggcaucuucggggccaucgccggcuucaucgagaacggcugggaggggaugguggacggcugguacggguuccgccaccagaacuccgagggcaucgggcaggccgccgaccucaagagcacccaggcggccaucaaccagaucaacggcaagcugaaccggcugaucggcaagaccaacgagaaguuccaccagaucgagaaggaguucuccgaggucgaggggcgcauccaggaccucgagaaguacguggaggacaccaagaucgaccuguggagcuacaacgccgagcugcucguggcccuggagaaccagcacacgaucgaccugaccgacuccgagaugaacaagcuguucgagcggaccgagaagcagcuccgcgagaacgccgaggacaugggcaacgggugcuucaagaucuaccacaagugcgacaacgcgggcaucgggagcauccgcaacggcaccuacgaccacgacgucuaccgggacgaggcccugaacaaccgcuuccagaucaagggcguggagcucaaguccggguacaaggacuggauccuguggaucagcuucgccaucuccugcuuccugcucugcguggcccugcugggcuucaucaugugggccugccagaaggggaacauccggugcaacaucugcaucuga

SEQ ID NO: 64023 - RNA, 1701 nt, Artificial Sequence; identical to SEQ ID NO: 63921
  derived and/or modified sequence opt1 from hemagglutinin__InfluenzaA__ACT21572

SEQ ID NO: 64024 - RNA, 1701 nt, Artificial Sequence; identical to SEQ ID NO: 63677
  derived and/or modified sequence opt1 from hemagglutinin__InfluenzaA__ACT22031

SEQ ID NO: 64025 - RNA, 1701 nt, Artificial Sequence; identical to SEQ ID NO: 63677
  derived and/or modified sequence opt1 from hemagglutinin__InfluenzaA__ACT22032

SEQ ID NO: 64026 - RNA, 1701 nt, Artificial Sequence; identical to SEQ ID NO: 63677
  derived and/or modified sequence opt1 from hemagglutinin__InfluenzaA__ACT22033

SEQ ID NO: 64027 - RNA, 1701 nt, Artificial Sequence; identical to SEQ ID NO: 63677
  derived and/or modified sequence opt1 from hemagglutinin__InfluenzaA__ACT22034

SEQ ID NO: 64028 - RNA, 1701 nt, Artificial Sequence; identical to SEQ ID NO: 63692
  derived and/or modified sequence opt1 from hemagglutinin__InfluenzaA__ACT22035

SEQ ID NO: 64029 - RNA, 1701 nt, Artificial Sequence
  derived and/or modified sequence opt1 from hemagglutinin__InfluenzaA__ACT22036
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucaucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggagcggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 64030 - RNA, 1701 nt, Artificial Sequence
  derived and/or modified sequence opt1 from hemagglutinin__InfluenzaA__ACT22037
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64031 - RNA, 1701 nt, Artificial Sequence
  derived and/or modified sequence opt1 from hemagglutinin__InfluenzaA__ACT22038
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaacgccgaccagcagucccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64032 - RNA, 1701 nt, Artificial Sequence
  derived and/or modified sequence opt1 from hemagglutinin__InfluenzaA__ACT22055
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcugcggaaguccuacaucaacgacaagggcaaggaggugcugguccucugggggauccaccaccccagcaccagcgccgaccagcagucccuguaccagaacgccgacgccuacguguucgugggcacgagccgcuacuccaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcgccucgcgaccggccugcggaacgucccgagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucagccugggggccaucuccuucuggaugugcagcaacggcucccugcagugccgcaucugcaucuga

SEQ ID NO: 64033 - RNA, 1701 nt, Artificial Sequence; identical to SEQ ID NO: 63990
  derived and/or modified sequence opt1 from hemagglutinin__InfluenzaA__ACT22504

SEQ ID NO: 64034 - RNA, 1701 nt, Artificial Sequence; identical to SEQ ID NO: 63919
  derived and/or modified sequence opt1 from hemagglutinin__InfluenzaA__ACT33122

SEQ ID NO: 64035 - RNA, 1701 nt, Artificial Sequence
  derived and/or modified sequence opt1 from hemagglutinin__InfluenzaA__ACT33123
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcaguuccggaucugcaucuga

SEQ ID NO: 64036 - RNA, 1701 nt, Artificial Sequence; identical to SEQ ID NO: 63677
  derived and/or modified sequence opt1 from hemagglutinin__InfluenzaA__ACT33125

SEQ ID NO: 64037 - RNA, 1701 nt, Artificial Sequence
  derived and/or modified sequence opt1 from hemagglutinin__InfluenzaA__ACT36505
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugaucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 64038 - RNA, 1701 nt, Artificial Sequence
  derived and/or modified sequence opt1 from hemagglutinin__InfluenzaA__ACT36649
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcccggagcugguccuacaucguggagaccagcuccagcgacaacggcacgugcuaccccggcgacuucaucgacuacgaggagcuccgcgagcagcugaacuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccuccaccagcgccgaccagcagagccuguaccagaacgccgacgccuacguguucgugggcuccagccgcuacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgucaagagccucuacgagaaggugcggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 64039 - RNA, 1701 nt, Artificial Sequence; identical to SEQ ID NO: 63677
  derived and/or modified sequence opt1 from hemagglutinin__InfluenzaA__ACT36650

SEQ ID NO: 64040 - RNA, 1701 nt, Artificial Sequence; identical to SEQ ID NO: 63677
  derived and/or modified sequence opt1 from hemagglutinin__InfluenzaA__ACT36652

SEQ ID NO: 64041 - RNA, 1701 nt, Artificial Sequence; identical to SEQ ID NO: 63675
  derived and/or modified sequence opt1 from hemagglutinin__InfluenzaA__ACT36653

SEQ ID NO: 64042 - RNA, 1701 nt, Artificial Sequence
  derived and/or modified sequence opt1 from hemagglutinin__InfluenzaA__ACT36655
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcuccagccgguacuccaagaaguucaagcccgagaucgccauccgcccgaagguccgggaccaggaggggcgcaugaacuacuacuggacgcugguggagcccggcgacaagaucaccuucgaggcgaccgggaaccucguggucccccgguacgccuucgccauggagcgcaacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgcgaccgggcugcgcaacgucccgagcauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacggcucccugcagugccggaucugcaucuga

SEQ ID NO: 64043 - RNA, 1701 nt, Artificial Sequence; identical to SEQ ID NO: 63664
  derived and/or modified sequence opt1 from hemagglutinin__InfluenzaA__ACT36658

SEQ ID NO: 64044 - RNA, 1701 nt, Artificial Sequence; identical to SEQ ID NO: 63703
  derived and/or modified sequence opt1 from hemagglutinin__InfluenzaA__ACT36659

SEQ ID NO: 64045 - RNA, 1701 nt, Artificial Sequence; identical to SEQ ID NO: 63664
  derived and/or modified sequence opt1 from hemagglutinin__InfluenzaA__ACT36661

SEQ ID NO: 64046 - RNA, 1701 nt, Artificial Sequence; identical to SEQ ID NO: 63677
  derived and/or modified sequence opt1 from hemagglutinin__InfluenzaA__ACT36663

SEQ ID NO: 64047 - RNA, 1701 nt, Artificial Sequence; identical to SEQ ID NO: 63677
  derived and/or modified sequence opt1 from hemagglutinin__InfluenzaA__ACT36666

SEQ ID NO: 64048 - RNA, 1701 nt, Artificial Sequence
  derived and/or modified sequence opt1 from hemagglutinin__InfluenzaA__ACT52687
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccggggccaggaggggcgcaugaacuacuacuggacgcugguggagcccggcgacaagaucaccuucgaggcgaccgggaaccucguggucccccgguacgccuucgccauggagcgcaacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgcgaccgggcugcgcaacgucccgagcauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcuucuaccagauccuggcgaucuacagcaccgucgccagcucccuggugcucguggucagccugggcgccaucuccuucuggaugugcagcaacggcucccugcagugccggaucugcaucuga

SEQ ID NO: 64049 - RNA, 1701 nt, Artificial Sequence; identical to SEQ ID NO: 63664
  derived and/or modified sequence opt1 from hemagglutinin__InfluenzaA__ACT54606

SEQ ID NO: 64050 - RNA, 1701 nt, Artificial Sequence; identical to SEQ ID NO: 63677
  derived and/or modified sequence opt1 from hemagglutinin__InfluenzaA__ACT66146

SEQ ID NO: 64051 - RNA, 1701 nt, Artificial Sequence; identical to SEQ ID NO: 63919
  derived and/or modified sequence opt1 from hemagglutinin__InfluenzaA__ACT66155

SEQ ID NO: 64052 - RNA, 1701 nt, Artificial Sequence
  derived and/or modified sequence opt1 from hemagglutinin__InfluenzaA__ACT66162
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcaccugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64053 - RNA, 1701 nt, Artificial Sequence; identical to SEQ ID NO: 63677
  derived and/or modified sequence opt1 from hemagglutinin__InfluenzaA__ACT67239

SEQ ID NO: 64054 - RNA, 1701 nt, Artificial Sequence; identical to SEQ ID NO: 63677
  derived and/or modified sequence opt1 from hemagglutinin__InfluenzaA__ACT67255

SEQ ID NO: 64055 - RNA, 1701 nt, Artificial Sequence; identical to SEQ ID NO: 63664
  derived and/or modified sequence opt1 from hemagglutinin__InfluenzaA__ACT68102

SEQ ID NO: 64056 - RNA, 1701 nt, Artificial Sequence
  derived and/or modified sequence opt1 from hemagglutinin__InfluenzaA__ACT68103
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagacccugaagggcgccaucaacaccagccugccguuccagaacauccaccccaucacgaucgggaagugccccaaguacgugaaguccaccaagcuccggcuggcgaccggccugcgcaacguccccagcauccagucccggggccucuucggggccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcucaaccgggaggagaucgacggcgugaagcuggaguccacccgcaucuaccagauccuggcgaucuacagcaccgucgccagcucccucgugcugguggucagccugggggccaucuccuucuggaugugcagcaacggcucccuccagugccggaucugcaucuga

SEQ ID NO: 64057 - RNA, 1701 nt, Artificial Sequence; identical to SEQ ID NO: 63664
  derived and/or modified sequence opt1 from hemagglutinin__InfluenzaA__ACT68104

SEQ ID NO: 64058 - RNA, 1701 nt, Artificial Sequence
  derived and/or modified sequence opt1 from hemagglutinin__InfluenzaA__ACT68105
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcggcgaggccaagcugaaccgcgaggagaucgacggggugaagcucgaguccacccggaucuaccagauccuggcgaucuacagcaccgucgccagcucccuggugcucguggucagccugggcgccaucuccuucuggaugugcagcaacggcucccugcagugccgcaucugcaucuga

SEQ ID NO: 64059 - RNA, 1701 nt, Artificial Sequence; identical to SEQ ID NO: 63664
  derived and/or modified sequence opt1 from hemagglutinin__InfluenzaA__ACT68106

SEQ ID NO: 64060 - RNA, 1701 nt, Artificial Sequence; identical to SEQ ID NO: 63664
  derived and/or modified sequence opt1 from hemagglutinin__InfluenzaA__ACT68107

SEQ ID NO: 64061 - RNA, 1701 nt, Artificial Sequence; identical to SEQ ID NO: 63857
  derived and/or modified sequence opt1 from hemagglutinin__InfluenzaA__ACT68108

SEQ ID NO: 64062 - RNA, 1701 nt, Artificial Sequence
  derived and/or modified sequence opt1 from hemagglutinin__InfluenzaA__ACT68109
augaaggccauccuggugguccuccuguacaccuucgccaccgcgaacacggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 64063 - RNA, 1701 nt, Artificial Sequence; identical to SEQ ID NO: 63664
  derived and/or modified sequence opt1 from hemagglutinin__InfluenzaA__ACT68110

SEQ ID NO: 64064 - RNA, 1701 nt, Artificial Sequence; identical to SEQ ID NO: 63664
  derived and/or modified sequence opt1 from hemagglutinin__InfluenzaA__ACT68112

SEQ ID NO: 64065 - RNA, 1701 nt, Artificial Sequence; identical to SEQ ID NO: 63664
  derived and/or modified sequence opt1 from hemagglutinin__InfluenzaA__ACT68113

SEQ ID NO: 64066 - RNA, 1701 nt, Artificial Sequence; identical to SEQ ID NO: 63664
  derived and/or modified sequence opt1 from hemagglutinin__InfluenzaA__ACT68115

SEQ ID NO: 64067 - RNA, 1701 nt, Artificial Sequence; identical to SEQ ID NO: 63664
  derived and/or modified sequence opt1 from hemagglutinin__InfluenzaA__ACT68119

SEQ ID NO: 64068 - RNA, 1701 nt, Artificial Sequence
  derived and/or modified sequence opt1 from hemagglutinin__InfluenzaA__ACT79133
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggaagcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64069 - RNA, 1701 nt, Artificial Sequence; identical to SEQ ID NO: 63664
  derived and/or modified sequence opt1 from hemagglutinin__InfluenzaA__ACT79143

SEQ ID NO: 64070 - RNA, 1701 nt, Artificial Sequence; identical to SEQ ID NO: 63703
  derived and/or modified sequence opt1 from hemagglutinin__InfluenzaA__ACT79153

SEQ ID NO: 64071 - RNA, 1701 nt, Artificial Sequence; identical to SEQ ID NO: 63990
  derived and/or modified sequence opt1 from hemagglutinin__InfluenzaA__ACT79163

SEQ ID NO: 64072 - RNA, 1701 nt, Artificial Sequence; identical to SEQ ID NO: 63990
  derived and/or modified sequence opt1 from hemagglutinin__InfluenzaA__ACT79173

SEQ ID NO: 64073 - RNA, 1701 nt, Artificial Sequence
  derived and/or modified sequence opt1 from hemagglutinin__InfluenzaA__ACT79625
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaagaucgacgacggcuuccucgacaucuggaccuacaacgccgagcugcugguccuccugaagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccaacggcagccugcagugccggaucugcaucuga

SEQ ID NO: 64074 - RNA, 1701 nt, Artificial Sequence; identical to SEQ ID NO: 63664
  derived and/or modified sequence opt1 from hemagglutinin__InfluenzaA__ACT79627

SEQ ID NO: 64075 - RNA, 1701 nt, Artificial Sequence
  derived and/or modified sequence opt1 from hemagglutinin__InfluenzaA__ACT82512
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccaguucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 64076 - RNA, 1701 nt, Artificial Sequence; identical to SEQ ID NO: 63677
  derived and/or modified sequence opt1 from hemagglutinin__InfluenzaA__ACT82513

SEQ ID NO: 64077 - RNA, 1701 nt, Artificial Sequence
  derived and/or modified sequence opt1 from hemagglutinin__InfluenzaA__ACT82514
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcaacacgcccgugcacgacugcaacacgaccugccagaccccgaagggcuccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 64078 - RNA, 1701 nt, Artificial Sequence; identical to SEQ ID NO: 63677
  derived and/or modified sequence opt1 from hemagglutinin__InfluenzaA__ACT82515

SEQ ID NO: 64079 - RNA, 1701 nt, Artificial Sequence
  derived and/or modified sequence opt1 from hemagglutinin__InfluenzaA__ACT82516
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucauggugccccgguacgccuucgccauggagcgcaacgccgggagcggcaucaucaucuccgacacccccguccacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 64080 - RNA, 1701 nt, Artificial Sequence; identical to SEQ ID NO: 63919
  derived and/or modified sequence opt1 from hemagglutinin__InfluenzaA__ACT83795

SEQ ID NO: 64081 - RNA, 1701 nt, Artificial Sequence; identical to SEQ ID NO: 63919
  derived and/or modified sequence opt1 from hemagglutinin__InfluenzaA__ACT83805

SEQ ID NO: 64082 - RNA, 1701 nt, Artificial Sequence; identical to SEQ ID NO: 63677
  derived and/or modified sequence opt1 from hemagglutinin__InfluenzaA__ACT83815

SEQ ID NO: 64083 - RNA, 1701 nt, Artificial Sequence; identical to SEQ ID NO: 63677
  derived and/or modified sequence opt1 from hemagglutinin__InfluenzaA__ACT83825

SEQ ID NO: 64084 - RNA, 1701 nt, Artificial Sequence; identical to SEQ ID NO: 63677
  derived and/or modified sequence opt1 from hemagglutinin__InfluenzaA__ACT83835

SEQ ID NO: 64085 - RNA, 1701 nt, Artificial Sequence; identical to SEQ ID NO: 63770
  derived and/or modified sequence opt1 from hemagglutinin__InfluenzaA__ACT83845

SEQ ID NO: 64086 - RNA, 1701 nt, Artificial Sequence; identical to SEQ ID NO: 63664
  derived and/or modified sequence opt1 from hemagglutinin__InfluenzaA__ACT83855

SEQ ID NO: 64087 - RNA, 1701 nt, Artificial Sequence; identical to SEQ ID NO: 63677
  derived and/or modified sequence opt1 from hemagglutinin__InfluenzaA__ACT83865

SEQ ID NO: 64088 - RNA, 1701 nt, Artificial Sequence; identical to SEQ ID NO: 63919
  derived and/or modified sequence opt1 from hemagglutinin__InfluenzaA__ACT83875

SEQ ID NO: 64089 - RNA, 1701 nt, Artificial Sequence; identical to SEQ ID NO: 63919
  derived and/or modified sequence opt1 from hemagglutinin__InfluenzaA__ACT85999

SEQ ID NO: 64090 - RNA, 1701 nt, Artificial Sequence; identical to SEQ ID NO: 63919
  derived and/or modified sequence opt1 from hemagglutinin__InfluenzaA__ACT86009

SEQ ID NO: 64091 - RNA, 1701 nt, Artificial Sequence; identical to SEQ ID NO: 63677
  derived and/or modified sequence opt1 from hemagglutinin__InfluenzaA__ACT86019

SEQ ID NO: 64092 - RNA, 1701 nt, Artificial Sequence; identical to SEQ ID NO: 63770
  derived and/or modified sequence opt1 from hemagglutinin__InfluenzaA__ACT86029

SEQ ID NO: 64093 - RNA, 1701 nt, Artificial Sequence; identical to SEQ ID NO: 63677
  derived and/or modified sequence opt1 from hemagglutinin__InfluenzaA__ACT86039

SEQ ID NO: 64094 - RNA, 1701 nt, Artificial Sequence; identical to SEQ ID NO: 63677
  derived and/or modified sequence opt1 from hemagglutinin__InfluenzaA__ACT86059

SEQ ID NO: 64095 - RNA, 1701 nt, Artificial Sequence; identical to SEQ ID NO: 63677
  derived and/or modified sequence opt1 from hemagglutinin__InfluenzaA__ACT86069

SEQ ID NO: 64096 - RNA, 1701 nt, Artificial Sequence; identical to SEQ ID NO: 63677
  derived and/or modified sequence opt1 from hemagglutinin__InfluenzaA__ACT86079

SEQ ID NO: 64097 - RNA, 1701 nt, Artificial Sequence; identical to SEQ ID NO: 63677
  derived and/or modified sequence opt1 from hemagglutinin__InfluenzaA__ACT86089

SEQ ID NO: 64098 - RNA, 1701 nt, Artificial Sequence; identical to SEQ ID NO: 63677
  derived and/or modified sequence opt1 from hemagglutinin__InfluenzaA__ACT86099

SEQ ID NO: 64099 - RNA, 1701 nt, Artificial Sequence; identical to SEQ ID NO: 63919
  derived and/or modified sequence opt1 from hemagglutinin__InfluenzaA__ACT86109

SEQ ID NO: 64100 - RNA, 1701 nt, Artificial Sequence; identical to SEQ ID NO: 63677
  derived and/or modified sequence opt1 from hemagglutinin__InfluenzaA__ACT86119

SEQ ID NO: 64101 - RNA, 1701 nt, Artificial Sequence; identical to SEQ ID NO: 63919
  derived and/or modified sequence opt1 from hemagglutinin__InfluenzaA__ACT86129

SEQ ID NO: 64102 - RNA, 1701 nt, Artificial Sequence; identical to SEQ ID NO: 63677
  derived and/or modified sequence opt1 from hemagglutinin__InfluenzaA__ACT86139

SEQ ID NO: 64103 - RNA, 1701 nt, Artificial Sequence
  derived and/or modified sequence opt1 from hemagglutinin__InfluenzaA__ACU00932
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaacuucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64104 - RNA, 1701 nt, Artificial Sequence; identical to SEQ ID NO: 63677
  derived and/or modified sequence opt1 from hemagglutinin__InfluenzaA__ACU00942

SEQ ID NO: 64105 - RNA, 1701 nt, Artificial Sequence; identical to SEQ ID NO: 63677
  derived and/or modified sequence opt1 from hemagglutinin__InfluenzaA__ACU00952

SEQ ID NO: 64106 - RNA, 1701 nt, Artificial Sequence
  derived and/or modified sequence opt1 from hemagglutinin__InfluenzaA__ACU12494
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaucaacgaggacuucaacuggaccgggguggcccagagcggcgaguccuacgccugcaagcgcgggagcgugaaguccuucuucagccggcucaacuggcugcacgaguccgacuacaaguaccccgcgcugaacgucaccaugcccaacaacggcaaguucgacaagcucuacaucuggggcgugcaccaccccaucaccgaccgcgagcagacgagccuguacgugcgggccuccgggcgcgucaccgugagcaccaagcggagccagcagaccgugaucccgaacaucggcucccgccccuggguccgggggcugagcucccgcaucagcaucuacuggacgaucgugaagcccggcgacauccuccugaucaacuccaccgggaaccugaucgcgccccggggcuacuucaagauccgcaccggcaagagcuccaucaugcggagcgacgccccgaucgggaccugcuccagcgagugcaucacgcccaacggcuccauccccaacgacaagcccuuccagaacgugaaccgcaucaccuacggggccugcccgcgguacgucaagcagaacacccucaagcuggccaccggcaugcgcaacgugcccgagaagcagacgcgggggaucuucggcgccaucgccggcuucaucgagaacgggugggagggcaugguggacgggugguacggcuuccgccaccagaacagcgaggggaccggccaggccgccgaccugaaguccacccaggcggccaucgaccagaucaacggcaagcucaaccggcugaucgagaagaccaacgagaaguuccaccagaucgagaaggaguucagcgaggucgaggggcgcauccaggaccuggagaaguacguggaggacacgaagaucgaccucugguccuacaacgccgagcugcugguggcccucgagaaccagcacaccaucgaccugaccgacagcgagaugaacaagcuguucgagaagacccgcaagcagcuccgggagaacgccgaggacaugggcaacgggugcuucaagaucuaccacaagugcgacaacgcgugcaucggcuccauccgcaacgggacguacgaccacgacgucuaccgggacgaggcccugaacaaccgcuuccagaucaagggcguggagcugaaguccggcuacaaggacuggauccucuggaucuccuucgccaucagcugcuuccugcugugcgucgugcuccugggguucaucaugugggccugccagaagggcaacauccggugcaacaucugcaucuga

SEQ ID NO: 64107 - RNA, 1698 nt, Artificial Sequence; identical to SEQ ID NO: 63789
  derived and/or modified sequence opt1 from hemagglutinin__InfluenzaA__ACU12505

SEQ ID NO: 64108 - RNA, 1701 nt, Artificial Sequence
  derived and/or modified sequence opt1 from hemagglutinin__InfluenzaA__ACU12516
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugguggacgcccugcucggcgacccccagugcgacggcuuccagaacaagaagugggaccuguucguggagcgcagcaaggccuacuccaacugcuaccccuacgacgucccggacuacgcgagccugcggucccucguggccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgucaccaugcccaacaacgagaaguucgacaagcucuacaucuggggcgugcaccaccccgggaccgacaacgaccagaucagccuguacgcgcaggccuccggccggaucaccgugagcacgaagcgcagccagcagaccgucaucccgaacaucggcucccggccccgcgugcgggacaucagcucccgcaucagcaucuacuggaccaucgugaagcccggggacauccugcucaucaacuccaccggcaaccugaucgcgccccggggguacuucaagauccgcagcggcaaguccagcaucaugcgguccgacgccccgaucggcaagugcaacagcgagugcaucacgcccaacggguccauccccaacgacaagcccuuccagaacgucaaccgcaucaccuacggcgccugcccgcgguacgugaagcagaacacccugaagcucgccaccgggaugcgcaacgugcccgagacgcagacccggggcaucuucggggccaucgccggcuucaucgagaacggcugggaggggauggucgacggcugguacggguuccgccaccagaacagcgagggcaccgggcaggccgccgaccugaaguccacccaggcggccaucaaccagaucaacggcaagcugaaccggcucaucggcaagacgaacgagaaguuccaccagaucgagaaggaguucagcgagguggaggggcgcauccaggaccuggagaaguacguggaggacaccaagaucgaccugugguccuacaacgccgagcuccuggucgcccuggagaaccagcacaccaucgaccucaccgacagcgagaugaacaagcuguucgagcggacgaagaagcagcugcgcgagaacgccgaggacaugggcaacgggugcuucaagaucuaccacaagugcgacaacgcgugcaucggcuccauccgcaacgggaccuacgaccacgacguguaccgggacgaggcccucaacaaccgcuuccagaucaagggcguggagcugaaguccggcuacaaggacuggauccuguggaucuccuucgccaucagcugcuuccuccugugcgucgcccugcucggguucaucaugugggccugccagaagggcaacauccggugcaacaucugcaucuga

SEQ ID NO: 64109 - RNA, 1701 nt, Artificial Sequence; identical to SEQ ID NO: 61638
  derived and/or modified sequence opt1 from hemagglutinin__InfluenzaA__ACU12527

SEQ ID NO: 64110 - RNA, 1701 nt, Artificial Sequence; identical to SEQ ID NO: 63380
  derived and/or modified sequence opt1 from hemagglutinin__InfluenzaA__ACU12538

SEQ ID NO: 64111 - RNA, 1701 nt, Artificial Sequence; identical to SEQ ID NO: 62576
  derived and/or modified sequence opt1 from hemagglutinin__InfluenzaA__ACU12549

SEQ ID NO: 64112 - RNA, 1698 nt, Artificial Sequence
  derived and/or modified sequence opt1 from hemagglutinin__InfluenzaA__ACU12560
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggggaaggaggugcucguccuguggggcgugcaccacccgcccaacaucggcgaccagaacacccuguaccacacggagaacgccuacgugagcgucgugagcucccacuacagccggaaguucacccccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucucccgcggcuucggcagcgggaucaucaacuccaacguccccauggacaagugcgacgccaagugccagacgccccagggcgccaucaacagcucccugcccuuccagaacgugcacccggugaccaucggggagugccccaaguacguccggagcgcgaagcugcgcauggugaccggccuccggaacauccccuccauccagagccgcgggcuguucggcgccaucgccggcuucaucgagggcggcuggaccgggaugguggacggcugguacggguaccaccaccagaacgagcagggcuccggcuacgccgccgaccagaaguccacgcagaacgcgaucaacgggaucaccaacaaggucaacagcgugaucgagaagaugaacacccaguucaccgccgucggcaaggaguucaacaagcuggagcggcgcauggagaaccucaacaagaagguggacgacggguucaucgacaucuggacguacaacgccgagcugcuggugcuccuggagaacgagcggacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggcgucaagcucgaguccauggggguguaccagauccuggccaucuacagcaccguggcgagcucccugguccuccuggugagccugggcgccaucuccuucuggaugugcagcaacgggucccuccagugccggaucugcaucuga

SEQ ID NO: 64113 - RNA, 1698 nt, Artificial Sequence; identical to SEQ ID NO: 63496
  derived and/or modified sequence opt1 from hemagglutinin__InfluenzaA__ACU12571

SEQ ID NO: 64114 - RNA, 1698 nt, Artificial Sequence
  derived and/or modified sequence opt1 from hemagglutinin__InfluenzaA__ACU12582
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccgcuucgccgacuacgaggagcugcgggagcagcucuccagcguguccagcuucgagcgcuucgagaucuucccgaaggaguccagcuggcccaaccacacggucaccgggguguccgccagcugcucccacaacggcgagagcuccuucuaccggaaccugcuguggcucaccgggaagaacggccuguaccccaaccugagcaaguccuacgccaacaacaaggggaaggaggugcucguccuguggggcgugcaccacccgcccaacaucggcgaccagaacacccuguaccacacggagaacgccuacgugagcgucgugagcucccacuacagccgcaaguucacccccgagaucgccaagcggcccaaggugcgcgaccaggaggggcggaucaacuacuacuggacccuccuggagcccggcgacaccaucaucuucgaggccaacgggaaccugaucgcgccgcgcuacgccuucgcccucucccggggcuucggcagcgggaucaucaacuccaacgcccccauggacaagugcgacgccaagugccagacgccccagggcgcgaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggcuucaucgagggcggcuggaccgggaugguggacggcugguacggguaccaccaccagaacgagcagggcuccggcuacgccgcggaccagaaguccacgcagaacgccaucaacgggaucaccaacaaggugaacagcgucaucgagaagaugaacacccaguucaccgccgugggcaaggaguucaacaagcuggagcgccggauggagaaccucaacaagaaggucgacgacggguucaucgacaucuggacguacaacgccgagcugcuggugcuccuggagaacgagcgcacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggcgugaagcucgaguccaugggggucuaccagauccuggcgaucuacagcaccguggccagcucccuggugcuccuggucagccugggcgccaucuccuucuggaugugcagcaacgggucccuccagugccgcaucugcaucuga

SEQ ID NO: 64115 - RNA, 1698 nt, Artificial Sequence
  derived and/or modified sequence opt1 from hemagglutinin__InfluenzaA__ACU12593
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucgacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacgggaucaagcucgaguccaugggcgucuaccagauccuggcgaucuacagcaccguggccagcucccuggugcuccuggucagccugggcgccaucuccuucuggaugugcagcaacgggucccuccagugccgcaucugcaucuga

SEQ ID NO: 64116 - RNA, 1701 nt, Artificial Sequence; identical to SEQ ID NO: 63677
  derived and/or modified sequence opt1 from hemagglutinin__InfluenzaA__ACU13090

SEQ ID NO: 64117 - RNA, 1701 nt, Artificial Sequence; identical to SEQ ID NO: 63677
  derived and/or modified sequence opt1 from hemagglutinin__InfluenzaA__ACU13091

SEQ ID NO: 64118 - RNA, 1701 nt, Artificial Sequence; identical to SEQ ID NO: 63677
  derived and/or modified sequence opt1 from hemagglutinin__InfluenzaA__ACU13092

SEQ ID NO: 64119 - RNA, 1701 nt, Artificial Sequence; identical to SEQ ID NO: 63677
  derived and/or modified sequence opt1 from hemagglutinin__InfluenzaA__ACU13093

SEQ ID NO: 64120 - RNA, 1701 nt, Artificial Sequence
  derived and/or modified sequence opt1 from hemagglutinin__InfluenzaA__ACU13094
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccggggccaggaggggcgcaugaacuacuacuggacgcugguggagcccggcgacaagaucaccuucgaggcgaccgggaaccucguggucccccgguacgccuucgccauggagcgcaacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgcgaccgggcugcgcaacgucccgagcauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacggcucccugcagugccggaucugcaucuga

SEQ ID NO: 64121 - RNA, 1701 nt, Artificial Sequence; identical to SEQ ID NO: 63677
  derived and/or modified sequence opt1 from hemagglutinin__InfluenzaA__ACU13095

SEQ ID NO: 64122 - RNA, 1701 nt, Artificial Sequence
  derived and/or modified sequence opt1 from hemagglutinin__InfluenzaA__ACU13096
augaaggccauccuggugguccuccugcacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugacccucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64123 - RNA, 1701 nt, Artificial Sequence; identical to SEQ ID NO: 63677
  derived and/or modified sequence opt1 from hemagglutinin__InfluenzaA__ACU13098

SEQ ID NO: 64124 - RNA, 1701 nt, Artificial Sequence
  derived and/or modified sequence opt1 from hemagglutinin__InfluenzaA__ACU13099
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccacagcaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64125 - RNA, 1701 nt, Artificial Sequence
  derived and/or modified sequence opt1 from hemagglutinin__InfluenzaA__ACU13129
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcgaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64126 - RNA, 1701 nt, Artificial Sequence; identical to SEQ ID NO: 63677
  derived and/or modified sequence opt1 from hemagglutinin__InfluenzaA__ACU16795

SEQ ID NO: 64127 - RNA, 1701 nt, Artificial Sequence; identical to SEQ ID NO: 63677
  derived and/or modified sequence opt1 from hemagglutinin__InfluenzaA__ACU16858

SEQ ID NO: 64128 - RNA, 1701 nt, Artificial Sequence; identical to SEQ ID NO: 63677
  derived and/or modified sequence opt1 from hemagglutinin__InfluenzaA__ACU16930

SEQ ID NO: 64129 - RNA, 1701 nt, Artificial Sequence; identical to SEQ ID NO: 63677
  derived and/or modified sequence opt1 from hemagglutinin__InfluenzaA__ACU16993

SEQ ID NO: 64130 - RNA, 1701 nt, Artificial Sequence; identical to SEQ ID NO: 63677
  derived and/or modified sequence opt1 from hemagglutinin__InfluenzaA__ACU17059

SEQ ID NO: 64131 - RNA, 1701 nt, Artificial Sequence; identical to SEQ ID NO: 63677
  derived and/or modified sequence opt1 from hemagglutinin__InfluenzaA__ACU17126

SEQ ID NO: 64132 - RNA, 1701 nt, Artificial Sequence; identical to SEQ ID NO: 63768
  derived and/or modified sequence opt1 from hemagglutinin__InfluenzaA__ACU17187

SEQ ID NO: 64133 - RNA, 1701 nt, Artificial Sequence; identical to SEQ ID NO: 63677
  derived and/or modified sequence opt1 from hemagglutinin__InfluenzaA__ACU17258

SEQ ID NO: 64134 - RNA, 1701 nt, Artificial Sequence
  derived and/or modified sequence opt1 from hemagglutinin__InfluenzaA__ACU17389
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacggccugccagaccccgaagggcgcgaucaacaccagccugcccuuccacaacauccaccccaucaccaucgggaagugccccaaguacgugaaguccacgaagcugcggcucgccaccggccugcgcaacgucccgagcauccagucccgggggcuguucggcgccaucgccggguucaucgagggcggcuggaccgggaugguggacggcugguacggguaccaccaccagaacgagcagggcagcggguacgccgcggaccucaaguccacccagaacgccaucgacgagaucacgaacaaggugaacagcgucaucgagaagaugaacacccaguucaccgccgugggcaaggaguucaaccaccuggagaagcgcaucgagaaccugaacaagaaggucgacgacggcuuccucgacaucuggaccuacaacgccgagcugcuggugcuccuggagaacgagcggacgcuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggcgaagcugaaccgggaggagaucgacggcgugaagcucgaguccacccgcaucuaccagauccuggccaucuacagcaccgucgccagcucccuggugcucguggucagccugggggccaucuccuucuggaugugcagcaacggcucccugcagugccggaucugcaucuga

SEQ ID NO: 64135 - RNA, 1701 nt, Artificial Sequence; identical to SEQ ID NO: 63677
  derived and/or modified sequence opt1 from hemagglutinin__InfluenzaA__ACU17450

SEQ ID NO: 64136 - RNA, 1701 nt, Artificial Sequence; identical to SEQ ID NO: 63677
  derived and/or modified sequence opt1 from hemagglutinin__InfluenzaA__ACU17521

SEQ ID NO: 64137 - RNA, 1701 nt, Artificial Sequence; identical to SEQ ID NO: 63664
  derived and/or modified sequence opt1 from hemagglutinin__InfluenzaA__ACU27041

SEQ ID NO: 64138 - RNA, 1698 nt, Artificial Sequence
  derived and/or modified sequence opt1 from hemagglutinin__InfluenzaA__ACU27406
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagauccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacguccacccggugaccaucggggagugccccaaguacgugcgcagcgccaagcugcggauggucaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggugaacagcgucaucgagcgcaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacagcaacgugaagaaccucuacgagaaggucaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgcgagaagaucgacggggugaagcucgaguccaugggcgucuaccagauccuggcgaucuacagcaccguggccagcucccuggugcuccuggucagccugggcgccaucuccuucuggaugugcagcaacgggucccuccagugccggaucugcaucuga

SEQ ID NO: 64139 - RNA, 1698 nt, Artificial Sequence
  derived and/or modified sequence opt1 from hemagglutinin__InfluenzaA__ACU27407
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacggggucaagcucgaguccaugggcguguaccagauccuggcgaucuacagcaccguggccagcucccugguccuccuggugagccugggcgccaucuccuucuggaugugcagcaacgggucccuccagugccgcaucugcaucuga

SEQ ID NO: 64140 - RNA, 1701 nt, Artificial Sequence; identical to SEQ ID NO: 63664
  derived and/or modified sequence opt1 from hemagglutinin__InfluenzaA__ACU29949

SEQ ID NO: 64141 - RNA, 1701 nt, Artificial Sequence
  derived and/or modified sequence opt1 from hemagglutinin__InfluenzaA__ACU29979
augaaggccauccuggugguccuccuguacaccuucgccgcggccaacgccgacacccugugcaucggcuaccacgccaacaacagcacggacaccguggacaccgugcucgagaagaacgucaccgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggcgucaccgccgccugcccgcacgcgggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagcccgagaucgcgauccgcccgaagguccgggaccaggagggccgcaugaacuacuacuggacgcugguggagcccggggacaagaucaccuucgaggccaccggcaaccucguggucccccgguacgccuucgccauggagcgcaacgccggguccggcaucaucaucagcgacacccccgugcacgacugcaacacgaccugccagaccccgaagggcgcgaucaacaccucccugcccuuccagaacauccaccccaucacgaucgggaagugccccaaguacgucaagagcaccaagcugcggcucgccaccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 64142 - RNA, 1701 nt, Artificial Sequence; identical to SEQ ID NO: 63677
  derived and/or modified sequence opt1 from hemagglutinin__InfluenzaA__ACU29989

SEQ ID NO: 64143 - RNA, 1704 nt, Artificial Sequence
  derived and/or modified sequence opt1 from hemagglutinin__InfluenzaA__ACU29999
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcuccagugccggaucugcaucuga

SEQ ID NO: 64144 - RNA, 1704 nt, Artificial Sequence
  derived and/or modified sequence opt1 from hemagglutinin__InfluenzaA__ACU30009
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcggcuacggcucccugcagugccggaucugcaucuga

SEQ ID NO: 64145 - RNA, 1701 nt, Artificial Sequence; identical to SEQ ID NO: 64037
  derived and/or modified sequence opt1 from hemagglutinin__InfluenzaA__ACU30019

SEQ ID NO: 64146 - RNA, 1701 nt, Artificial Sequence; identical to SEQ ID NO: 63857
  derived and/or modified sequence opt1 from hemagglutinin__InfluenzaA__ACU30093

SEQ ID NO: 64147 - RNA, 1701 nt, Artificial Sequence
  derived and/or modified sequence opt1 from hemagglutinin__InfluenzaA__ACU30103
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuaccacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64148 - RNA, 1704 nt, Artificial Sequence
  derived and/or modified sequence opt1 from hemagglutinin__InfluenzaA__ACU30112
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagccacauggugcugcuccagugccggaucugcaucuga

SEQ ID NO: 64149 - RNA, 1701 nt, Artificial Sequence
  derived and/or modified sequence opt1 from hemagglutinin__InfluenzaA__ACU30121
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcaaccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64150 - RNA, 1701 nt, Artificial Sequence; identical to SEQ ID NO: 63770
  derived and/or modified sequence opt1 from hemagglutinin__InfluenzaA__ACU31124

SEQ ID NO: 64151 - RNA, 1701 nt, Artificial Sequence; identical to SEQ ID NO: 63709
  derived and/or modified sequence opt1 from hemagglutinin__InfluenzaA__ACU31143

SEQ ID NO: 64152 - RNA, 1701 nt, Artificial Sequence; identical to SEQ ID NO: 63709
  derived and/or modified sequence opt1 from hemagglutinin__InfluenzaA__ACU31144

SEQ ID NO: 64153 - RNA, 1701 nt, Artificial Sequence; identical to SEQ ID NO: 63709
  derived and/or modified sequence opt1 from hemagglutinin__InfluenzaA__ACU31145

SEQ ID NO: 64154 - RNA, 1701 nt, Artificial Sequence; identical to SEQ ID NO: 63857
  derived and/or modified sequence opt1 from hemagglutinin__InfluenzaA__ACU31146

SEQ ID NO: 64155 - RNA, 1701 nt, Artificial Sequence; identical to SEQ ID NO: 63677
  derived and/or modified sequence opt1 from hemagglutinin__InfluenzaA__ACU31147

SEQ ID NO: 64156 - RNA, 1701 nt, Artificial Sequence
  derived and/or modified sequence opt1 from hemagglutinin__InfluenzaA__ACU31148
augaaggccauccuggugaucaugcucuacaccuucgccaccgcgaacgccgacacgcugugcaucggcuaccacgccaacaacagcaccgacaccgucgacaccgugcuggagaagaacgugacggucacccacuccgugaaccuccuggaggacaagcacaacgggaagcugugcaagcuccgcggcguggcgccccugcaccuggggaagugcaacaucgccggcuggauccucgggaacccggagugcgagagccuguccaccgccagcuccuggagcuacaucgucgagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcuggucaagaaggggaacagcuaccccaagcucuccaagagcuacaucaacgacaagggcaaggaggugcuggugcugugggggauccaccaccccagcaccuccgccgaccagcagagccucuaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccugguggugccccgguacgccuucgccauggagcgcaacgccgggagcggcaucaucaucuccgacacccccguccacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgugccgagcauccagucccgggggcuguucggcgccaucgccggguucaucgagggcggcuggaccgggauggucgacggcugguacggguaccaccaccagaacgagcagggcagcggguacgccgccgaccugaaguccacgcagaacgcgaucgacgagaucaccaacaaggugaacagcgugaucgagaagaugaacacccaguucaccgccgucggcaaggaguucaaccaccucgagaagcgcaucgagaaccugaacaagaagguggacgacggcuuccuggacaucuggacguacaacgccgagcuccugguccugcucgagaacgagcggacccuggacuaccacgacuccaacgugaagaaccuguacgagaaggugcgcagccagcucaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcuggaguccacccgcaucuaccagauccucgcgaucuacagcaccguggccagcucccugguccugguggugagccucggggccaucuccuucuggaugugcagcaacggcucccugcagugccggaucugcaucuga

SEQ ID NO: 64157 - RNA, 1701 nt, Artificial Sequence; identical to SEQ ID NO: 63664
  derived and/or modified sequence opt1 from hemagglutinin__InfluenzaA__ACU31149

SEQ ID NO: 64158 - RNA, 1701 nt, Artificial Sequence; identical to SEQ ID NO: 63664
  derived and/or modified sequence opt1 from hemagglutinin__InfluenzaA__ACU31150

SEQ ID NO: 64159 - RNA, 1701 nt, Artificial Sequence; identical to SEQ ID NO: 63664
  derived and/or modified sequence opt1 from hemagglutinin__InfluenzaA__ACU31151

SEQ ID NO: 64160 - RNA, 1701 nt, Artificial Sequence; identical to SEQ ID NO: 63664
  derived and/or modified sequence opt1 from hemagglutinin__InfluenzaA__ACU31152

SEQ ID NO: 64161 - RNA, 1707 nt, Artificial Sequence
  derived and/or modified sequence opt1 from hemagglutinin__InfluenzaA__ACU46644
auggagaagaucgugcugcuguucgccaucgucagccuggugaaguccgaccagaucugcaucggcuaccacgccaacaacagcaccgagcaggucgacaccaucauggagaagaacgugacggugacccacgcgcaggacauccuggagaagacccacaacgggaagcucugcgaccuggacggcgggaagccccugauccuccgcgacugccggguggccggcuggcugcuggggaacccgaugugcgacgaguucaucaacguccccgagugguccuacaucguggagaaggccaaccccgugaacgaccucugcuaccccggcgacuucaacgacuacgaggagcugaagcaccuccucagccgcaucaaccacuucgagaagauccagaucaucccgaaguccagcugguccagccacgaggccucccugggcgucagcuccgccugccccuaccagggcaagagcuccuucuuccggaacgugguguggcugaucaagaagaacagcaccuaccccacgaucaagcgcuccuacaacaacaccaaccaggaggaccuccugguccugugguggauccaccaccccaacgacgcggccgagcagaccaagcucuaccagaacccgaccacguacaucagcguggggaccuccacccugaaccagcggcuggugccccgcaucgccacccggagcaaggucaacgggcaguccggccgcauggaguucuucuggacgauccucaagcccaacgacgccaucaacuucgagagcaacgggaacuucaucgcgcccgaguacgccuacaagaucgugaagaagggcgacagcaccaucaugaaguccgagcuggaguacggcaacugcaacaccaagugccagaccccgaugggggccaucaacagcuccaugcccuuccaccacauccacccccugacgaucggcgagugccccaaguacgucaagagcaaccggcucgugcuggccaccgggcugcgcaacuccccgcagcgggagcgccggcgcaagaagcggggccucuucggcgccaucgcgggguucaucgagggcggguggcagggcaugguggacgggugguacggcuaccaccacagcaacgagcagggcuccggguacgccgccgacaaggagagcacccagaaggccaucgacggcgugaccaacaaggucaacuccaucaucgacaagaugaacacgcaguucgaggccguggggcgcgaguucaaccaccuggagcggcgcaucgagaaccugaacaagaagauggaggacggcuuccucgacguguggaccuacaacgcggagcugcugguccucauggagaacgagcggacccuggacuuccacgacagcaacgugaagaaccuguacgacaagguccgccuccagcugcgggacaacgccaaggagcuggggaacggcugcuucgaguucuaccacaagugcgacgacgagugcauggaguccgugcgcaacggcaccuacgacuacccccaguacagcgaggaggcccgccucaagcgggaggagaucuccggggugaagcuggagagcaucggcaucuaccagauccuguccaucuacagcacggucgccuccagccucgcccuggcgaucaugguggccgggcugucccucuggaugugcagcaacggcagccugcagugccgcaucugcaucuga

SEQ ID NO: 64162 - RNA, 1701 nt, Artificial Sequence
  derived and/or modified sequence opt1 from hemagglutinin__InfluenzaA__ACU56924
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 64163 - RNA, 1701 nt, Artificial Sequence; identical to SEQ ID NO: 64030
  derived and/or modified sequence opt1 from hemagglutinin__InfluenzaA__ACU56931

SEQ ID NO: 64164 - RNA, 1701 nt, Artificial Sequence; identical to SEQ ID NO: 63677
  derived and/or modified sequence opt1 from hemagglutinin__InfluenzaA__ACU64792

SEQ ID NO: 64165 - RNA, 1701 nt, Artificial Sequence; identical to SEQ ID NO: 63857
  derived and/or modified sequence opt1 from hemagglutinin__InfluenzaA__ACU64801

SEQ ID NO: 64166 - RNA, 1701 nt, Artificial Sequence; identical to SEQ ID NO: 63857
  derived and/or modified sequence opt1 from hemagglutinin__InfluenzaA__ACU64812

SEQ ID NO: 64167 - RNA, 1701 nt, Artificial Sequence; identical to SEQ ID NO: 63326
  derived and/or modified sequence opt1 from hemagglutinin__InfluenzaA__ACU79871

SEQ ID NO: 64168 - RNA, 1701 nt, Artificial Sequence; identical to SEQ ID NO: 63324
  derived and/or modified sequence opt1 from hemagglutinin__InfluenzaA__ACU79882

SEQ ID NO: 64169 - RNA, 1701 nt, Artificial Sequence; identical to SEQ ID NO: 63337
  derived and/or modified sequence opt1 from hemagglutinin__InfluenzaA__ACU79893

SEQ ID NO: 64170 - RNA, 1701 nt, Artificial Sequence; identical to SEQ ID NO: 63337
  derived and/or modified sequence opt1 from hemagglutinin__InfluenzaA__ACU79904

SEQ ID NO: 64171 - RNA, 1698 nt, Artificial Sequence
  derived and/or modified sequence opt1 from hemagglutinin__InfluenzaA__ACU79937
augaaggccaagcugcucgugcugcugugcaccuucaccgccacguacgcggacaccaucugcaucggcuaccacgccaacaacagcaccgacaccgucgacacggugcucgagaagaacgugaccgucacccacuccgugaaccugcuggaggacagccacaacgggaagcucugccugcugaagggcaucgcgccccuccagcuggggaacugcuccguggccggcuggauccuggggaacccggagugcgagagccucaucuccaaggagagcugguccuacaucgucgagacccccaaccccgagaacggcacgugcuaccccggcuacuucgccgacuacgaggagcugcgcgagcagcugagcuccgugagcuccuucgagcgguucgagaucuucccgaaggagagcuccuggcccaaccacaccgugaccggggucaccgccagcugcucccacaacggcaagagcuccuucuaccgcaaccuccuguggcugacggagaagaacgggcucuaccccaaccugagcaacuccuacgugaacaacaaggagaaggaggugcugguccucuggggcgugcaccaccccagcaacaucggggugcagcgggccaucuaccacaccgagaacgccuacgucagcgugguguccagccacuacucccgccgguucaccccggagaucgccaagcgccccaagguccggggccaggagggccgcaucaacuacuacuggacccugcuggagcccggggacacgaucaucuucgaggcgaacggcaaccucaucgcccccugguacgccuucgcccugagccggggguucggcuccggcaucaucaccagcaacgccccgaugaacgagugcgacgcgaagugccagacgccccagggggccaucaacuccagccugcccuuccagaacgugcaccccgugaccaucggcgagugcccgaaguacguccgcuccaccaagcuccggauggugaccgggcugcgcaacauccccagcauccagucccggggccuguucggggccaucgccggcuucaucgagggcggguggaccggcaugauggacgggugguacggcuaccaccaccagaacgagcaggggagcggcuacgccgcggaccagaaguccacccagaacgccaucaacggcaucacgaacaaggugaacagcgucaucgagaagaugaacacccaguucaccgccguggggaaggaguucaacaagcucgagcgccggauggagaaccugaacaagaaggucgacgacggcuuccuggacaucuggaccuacaacgccgagcuccuggugcugcucgagaacgagcgcacgcuggacuuccacgacuccaacgugaagaaccuguacgagaaggucaagagccagcucaagaacaacgccaaggagaucgggaacggcugcuucgaguucuaccacaagugcaacaacgagugcauggaguccgugaagaacgggaccuacgacuaccccaaguacagcgaggaguccaagcugaaccgggagaagaucgacggcgugaagcuggagagcaugggcgucuaccagauccucgcgaucuacagcaccguggccuccagccuggugcugcucgucucccugggggccaucagcuucuggaugugcuccaacggcagccugcagugccgcaucugcaucuga

SEQ ID NO: 64172 - RNA, 1689 nt, Artificial Sequence
  derived and/or modified sequence opt1 from hemagglutinin__InfluenzaA__ACU79948
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggagcgacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgagaucgccacgcggcccaaggugaacggccagggcgggcgcauggaguucagcuggacccuccuggacaugugggacaccaucaacuucgaguccaccggcaaccugaucgcccccgaguacggguucaagaucagcaagcggggcuccagcgggaucaugaagacggagggcacccucgagaacugcgagaccaagugccagaccccgcugggcgccaucaacacgacccugcccuuccacaacgugcacccccucaccaucggggagugccccaaguacgucaagagcgagaagcuggugcuggcgaccggccuccgcaacgugccgcagaucgagucccgggggcuguucggcgccaucgccggguucaucgagggcggcuggcaggggauggucgacggcugguacggguaccaccacagcaacgaccagggcuccggguacgccgccgacaaggagagcacgcagaaggcguucgacggcaucaccaacaacgugaacuccgugaucgagaagaugaacacccaguucgaggccgucggcaaggaguucagcaaccuggagcgccggcucgagaaccugaacaagaagauggaggacggguuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucggcaacgggugcuucgaguucuaccacaagugcgacgacgagugcaugaacagcgugaagaacggcaccuacgacuaccccaaguacgaggaggaguccaagcugaaccggaacgagaucaagggcgugaagcugagcuccaugggggucuaccagauccucgccaucuacgccaccguggcgggcagccugucccuggccaucaugauggccgggaucagcuucuggaugugcuccaacggcagccuccagugccgcaucugcaucuga

SEQ ID NO: 64173 - RNA, 1689 nt, Artificial Sequence
  derived and/or modified sequence opt1 from hemagglutinin__InfluenzaA__ACU79959
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacgaagaaggggagcgacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgagaucgccacgcggcccaaggugaacggccagggcgggcgcauggaguucagcuggacccuccuggacaugugggacaccaucaacuucgaguccaccggcaaccugaucgcccccgaguacggguucaagaucagcaagcggggcuccagcgggaucaugaagacggagggcacccucgagaacugcgagaccaagugccagaccccgcugggcgccaucaacacgacccugcccuuccacaacgugcacccccucaccaucggggagugccccaaguacgucaagagcgagaagcuggugcuggcgaccggccuccgcaacgugccgcagaucgagucccgggggcuguucggcgccaucgccggguucaucgagggcggcuggcaggggauggucgacggcugguacggguaccaccacagcaacgaccagggcuccggguacgccgccgacaaggagagcacgcagaaggcguucgacggcaucaccaacaaggugaacuccgugaucgagaagaugaacacccaguucgaggccgucggcaaggaguucagcaaccuggagcgccggcucgagaaccugaacaagaagauggaggacggguuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucggcaacgggugcuucgaguucuaccacaagugcgacgacgagugcaugaacagcgugaagaacggcaccuacgacuaccccaaguacgaggaggaguccaagcugaaccggaacgagaucaagggcgugaagcugagcuccaugggggucuaccagauccucgccaucuacgccaccguggcgggcagccugucccuggccaucaugauggccgggaucagcuucuggaugugcuccaacggcagccuccagugccgcaucugcaucuga

SEQ ID NO: 64174 - RNA, 1701 nt, Artificial Sequence
  derived and/or modified sequence opt1 from hemagglutinin__InfluenzaA__ACU79970
augaagaccaucaucgcccugagcuacauccagugccucguguucgcccagaaguuccccggcaacgacaacuccaccgcgacgcugugccuggggcaccacgccgucccgaacggcaccaucgugaagaccaucaccaacgaccagaucgaggugacgaacgccaccgagcucguccagagcuccagcaccggggagaucugcgacagcccccaccagauccuggacggcgagaacugcacccugaucgacgcccuccugggggacccccagugcgacggcuuccagaacaagaacugggaccuguucguggagcgcagcaaggccuacuccaacugcuaccccuacgacgugccggacuacgcgagccuccggucccuggucgccagcuccggcacgcuggaguucaacaacgagagcuucaacuggaccggggugacccagaacggcaccuccagcgccugcauccgccgguccaacaacagcuucuucuccaagcucaacuggcugacgcacagcaaguucaaguaccccgcccugaacgugaccaugcccaacaacgagaacuucgacaagcucuacaucuggggcguccaccaccccgggaccgacaacgaccagaucuuccuguacgcgcaggccuccgggcgcaucaccgugagcacgaagcggagccagcagaccgugaucccgaacaucggcucccgcccccggguccgcaacauccccagccggaucuccaucuacuggaccaucgugaagcccggcgacauccugcucaucaacagcaccgggaaccugaucgccccgcgcggcuacuucaagauccgguccgggaaguccuccaucaugcgcagcgacgcccccaucggcaagugcaacuccgagugcaucacgcccaacggcagcauccccaacgacaagccguuccagaacgugaaccggaucaccuacggggccugcccccgcuacgucaagcagaacacccugaagcucgcgaccggcaugcggaacgugcccgagaagcagacgcgcgggaucuucggcgccaucgccggguucaucgagaacggcugggagggcaugguggacgggugguacggcuuccggcaccagaacuccgaggggaucggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacauggggaacggcugcuucaagaucuaccacaagugcgacaacgcgugcaucgggagcauccggaacggcaccuacgaccacgacgucuaccgcgacgaggcccucaacaaccgcuuccagaucaaggggguggagcugaaguccggcuacaaggacuggauccuguggaucagcuucgccaucuccugcuuccuccugugcaucgcccugcucggcuucaucaugugggccugccagaaggggaacauccggugcaacaucugcaucuga

SEQ ID NO: 64175 - RNA, 1698 nt, Artificial Sequence
  derived and/or modified sequence opt1 from hemagglutinin__InfluenzaA__ACU79981
augaaggugaagcugcucguccugcugugcaccuucaccgccacguacgccgacaccaucugcaucggcuaccacgcgaacaacagcaccgacaccguggacacggugcucgagcgcaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgggagcagcucuccagcguguccagcuucgagcgcuucgagaucuucccgaaggaguccagcuggcccaaccacacggucaccgggguguccgccagcugcucccacaacggcgagagcuccuucuaccggaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccgcaaguucacgcccgagaucgccaagcggcccaaggugcgcgaccaggagggccggaucaacuacuacuggacccuccugaagcccggggacaccaucaucuucgaggcgaacggcaaccugaucgccccgcgcuacgccuucgcccucucccggggguucggcagcggcaucaucaacuccaacgcccccauggacaagugcgacgcgaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcgccggauggagaaccucaacaagaaggucgacgacggcuucaucgacaucuggaccuacaacgccgagcugcuggugcuccuggagaacgagcgcacgcuggacuuccacgacagcaacgugaagaaccucuacgagaaggucaagucccagcugaagaacaacgcgaaggagaucgggaacggcugcuucgaguucuaccacaagugcaacgacgagugcauggagagcgugaagaacgggaccuacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 64176 - RNA, 1698 nt, Artificial Sequence
  derived and/or modified sequence opt1 from hemagglutinin__InfluenzaA__ACU79992
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggaggacaaccacaacgggaagcucugccugcugaagggcaaggcgccccuccagcuggggaacugcagcgucgccggcuggauccuggggaacccggagugcggccuccugaucuccaaggagagcugguccuacaucguggagcgccccaaccccgagaacgggaccugcuaccccgggcacuucgccgacuacgaggagcugcgggagcagcucagcuccgugagcuccuucgagcgcuucgagaucuucccgaaggagagcuccuggcccaaccacacggucaccggcgugagcgccuccugcagccacaacggggaguccagcuucuacaagaaccugcuguggcucaccggcaagaacgggcuguaccccaaccuguccaagagcuacgccaacaacaaggagaaggaggugcucguccuguggggcgugcaccacccgcccaacaucggcgaccagaugacccuguaccacaaggagaacgccuacguguccgucgugagcagccacuacucccggaaguucacgcccgagaucgccaagcgccccaaggugcgggaccaggaggggcgcaucaacuacuacuggacccuccuggagcccggcgacaccaucaucuucgaggccaacgggaaccugaucgcgccgcgguacgccuucgcccucagccgcggcuucggcuccgggaucaucaacagcaacgcccccauggacgagugcgacgccaagugccagacgccccagggcgcgaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggcuucaucgagggcggcuggaccgggaugguggacggcugguacggguaccaccaccagaacgagcagggcagcggcuacgccgcggaccagaaguccacccagaacgccaucaacgggaucacgaacaaggugaacagcgucaucgagaagaugaacacccaguucaccgccgugggcaaggaguucaacaagcuggagcggcgcauggagaaccucaacaagaaggucgacgacggguucaucgacguguggaccuacaacgccgagcugcuggugcuccuggagaacgagcggacgcuggacuuccacgacuccaacgucaagaaccucuacgagaaggugaagaaccagcugaagaacaacgccaaggagaucggcaacgggugcuucgaguucuaccacaagugcaacgacgagugcauggagagcgugaagaacggcaccuacgacuaccccaaguacuccgaggagagcaagcugucccgcgagaagaucgacggcgucaagcucgagagcauggggguguaccagauccuggcgaucuacuccaccguggccagcagccugguccuccuggugucccugggcgccaucagcuucuggaugugcuccaacgggagccuccagugccggaucugcaucuga

SEQ ID NO: 64177 - RNA, 1701 nt, Artificial Sequence; identical to SEQ ID NO: 63442
  derived and/or modified sequence opt1 from hemagglutinin__InfluenzaA__ACU80003

SEQ ID NO: 64178 - RNA, 1698 nt, Artificial Sequence
  derived and/or modified sequence opt1 from hemagglutinin__InfluenzaA__ACU80025
augaaggugaagcugcucguccugcugugcaccuucgccgccaccuacgcggacacgaucugcaucggcuaccacgccaacaacagcaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacaccgucacggggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacccccgagaucgcgaagcgccccaaggugcgggaccaggagggccgcaucaacuacuacuggacgcuccuggagcccggggacaccaucaucuucgaggccaacggcaaccugaucgccccgcgguacgccuucgcccucucccgcggguucggcagcggcaucaucaacuccaacgcgcccauggacaagugcgacgccaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggugaacagcgucaucgagaagaugaacacgcaguucaccgccguggggaaggaguucaacaagcuggagcggcgcauggagaaccucaacaagaaggucgacgacggcuucaucgacaucuggaccuacaacgcggagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcugaaccgcgagaagaucgacggcgugaagcucgaguccaugggcgucuaccagauccuggccaucuacagcaccguggccagcucccuggugcuccuggucagccugggggccaucuccuucuggaugugcagcaacggcucccuccagugccggaucugcaucuga

SEQ ID NO: 64179 - RNA, 1701 nt, Artificial Sequence
  derived and/or modified sequence opt1 from hemagglutinin__InfluenzaA__ACU80036
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcagcuccgagugcaucacgcccaacggcagcauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccugaaguccacccaggcggccaucgaccagaucaacgggaagcugaaccgccucaucggcaagaccaacgagaaguuccaccagaucgagaaggaguucuccgaggucgagggccggauccaggaccuggagaaguacguggaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgccgaggacaucgggaacggcugcuucaagaucuaccacaagugcgacaacgcgugcaucgggagcauccgcaacggcaccuacgaccacgacgucuaccgggacgaggcccucaacaaccgcuuccagaucaaggggguggagcugaaguccggcuacaaggacuggauccuguggaucagcuucgccaucuccugcuuccuccugugcguggcccugcucggcuucaucaugugggccugccagaaggggaacauccggugcaacaucugcaucuga

SEQ ID NO: 64180 - RNA, 1698 nt, Artificial Sequence; identical to SEQ ID NO: 63651
  derived and/or modified sequence opt1 from hemagglutinin__InfluenzaA__ACU80047

SEQ ID NO: 64181 - RNA, 1701 nt, Artificial Sequence
  derived and/or modified sequence opt1 from hemagglutinin__InfluenzaA__ACU80058
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccgggggcaucugcgacagcccccaccagauccucgacggggagaacugcacccugaucgacgcccugcucggcgacccccagugcgacggcuuccagaacaagaagugggaccuguucguggagcgcagcaaggccugcuccaacugcuaccccuacgacgugccggacuacgcgagccugcggucccucgucgccagcuccgggacgcuggaguucaacaacgagagcuucaacuggaccggcgugacccagaacgggaccuccagcgccugcaagcgccgguccaacaacagcuucuucucccgccugaacuggcucacgcaccugaaguucaaguaccccgcccugaacgugaccaugcccaacaacgagaaguucgacaagcucuacaucuggggcguccaccaccccgggaccgacaacgaccagaucuuccuguacgcgcaggccagcggccggaucaccguguccacgaagcgcagccagcagaccgugaucccgaacaucggcagccggccccgcguccggaacauccccucccgcaucagcaucuacuggaccaucgugaagcccggggacauccugcucaucaacuccaccggcaaccugaucgccccgcggggguacuucaagauccgcagcggcaaguccagcaucaugcgguccgacgcccccaucggcaagugcaacagcgagugcaucacgcccaacggguccauccccaacgacaagccguuccagaacgugaaccgcaucaccuacggcgccugcccccgguacgucaagcagaacacccugaagcucgcgaccgggaugcgcaacgugcccgagaagcagacgcggggcaucuucggggccaucgccggcuucaucgagaacggcugggaggggaugguggacggcugguacggguuccgccaccagaacagcgagggcaucgggcaggccgccgaccugaaguccacccaggcggccaucaaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagcggaccaagaagcagcugcgcgagaacgccgaggacaugggcaacgggugcuucaagaucuaccacaagugcgacaacgcgugcaucggcuccauccgcaacgggaccuacgaccacgacgucuaccgggacgaggcccucaacaaccgcuuccagaucaagggcguggagcugaaguccggcuacaaggacuggauccuguggaucuccuucgccaucagcugcuuccuccugugcguggcccugcucggguucaucaugugggccugccagaagggcaacauccggugcaacaucugcaucuga

SEQ ID NO: 64182 - RNA, 1698 nt, Artificial Sequence; identical to SEQ ID NO: 63496
  derived and/or modified sequence opt1 from hemagglutinin__InfluenzaA__ACU80069

SEQ ID NO: 64183 - RNA, 1698 nt, Artificial Sequence
  derived and/or modified sequence opt1 from hemagglutinin__InfluenzaA__ACU80080
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucguggaccagaagacccuguaccggacggagaacgccuacgucagcguggugagcucccacuacagccgcaaguucacccccgagaucgccaagcggcccaagguccgcgaccaggagggccggaucaacuacuacuggacccuccuggagcccggcgacaccaucaucuucgaggccaacgggaaccugaucgcgccgcgcuacgccuucgcccucucccggggcuucgggagcggcaucaucaacuccaacgcccccauggacaagugcgacgccaagugccagacgccccagggcgcgaucaacagcucccugcccuuccagaacgugcacccggugaccaucggggagugccccaaguacguccgcagcgccaagcugcggauggugaccggccuccgcaacauccccuccauccagagccgggggcuguucggcgccaucgccggguucaucgagggcggcuggaccgggaugguggacggcugguacggguaccaccaccagaacgagcagggcuccggguacgccgcggaccagaaguccacgcagaacgccaucaacggcaucaccaacaaggucaacagcgugaucgagaagaugaacacccaguucaccgccgucggcaaggaguucaacaagcuggagcgccggauggagaaccucaacaagaagguggacgacggguucaucgacaucuggacguacaacgccgagcugcuggugcuccuggagaacgagcgcacccuggacuuccacgacagcaacgucaagaaccucuacgagaaggugaagucccagcugaagaacaacgccaaggagaucggcaacgggugcuucgaguucuaccacaagugcaacgacgagugcauggagagcgugaagaacggcaccuacgacuaccccaaguacuccgaggagagcaagcugaaccgggagaagaucgacgggaucaagcucgaguccaugggcgucuaccagauccuggcgaucuacagcaccguggccagcucccuggugcuccuggucagccugggcgccaucuccuucuggaugugcagcaacgggucccuccagugccgcaucugcaucuga

SEQ ID NO: 64184 - RNA, 1698 nt, Artificial Sequence; identical to SEQ ID NO: 63782
  derived and/or modified sequence opt1 from hemagglutinin__InfluenzaA__ACU80091

SEQ ID NO: 64185 - RNA, 1701 nt, Artificial Sequence; identical to SEQ ID NO: 63545
  derived and/or modified sequence opt1 from hemagglutinin__InfluenzaA__ACU80102

SEQ ID NO: 64186 - RNA, 1701 nt, Artificial Sequence
  derived and/or modified sequence opt1 from hemagglutinin__InfluenzaA__ACU80113
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcacagcaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccuccugaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgagaucgagggccgcauccaggaccuggagaaguacgucgaggacaccaagaucgaccucuggagcuacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacguguaccgcgacgaggcccugaacaaccgguuccagaucaagggggucgagcugaaguccggcuacaagaacuggauccucuggaucagcuucgccaucuccugcuuccugcugugcaucgcccuccugggcuucaucaugugggccugccagaaggggaacauccgcugcaacaucugcaucuga

SEQ ID NO: 64187 - RNA, 1701 nt, Artificial Sequence
  derived and/or modified sequence opt1 from hemagglutinin__InfluenzaA__ACU80135
augaagaccaucaucgcccugagcuacauccucugccugguguucgcccagaaguuccccggcaacgacaacuccaccgcgacgcugugccucgggcaccacgccgucccgaacggcaccauggugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcacagcaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccuccugaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccuggagaaguacguggaggacaccaagaucgaccucuggagcuacaacgccgagcugcugguggcccucgagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcugaaguccggcuacaaggacuggauccucuggaucagcuucgccaucuccugcuuccugcugugcaucgcccuccugggcuucaucaugugggccugccagaaggggaacauccgcugcaacaucugcaucuga

SEQ ID NO: 64188 - RNA, 1701 nt, Artificial Sequence
  derived and/or modified sequence opt1 from hemagglutinin__InfluenzaA__ACU80146
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcacagcaaguucaaguaccccgcccugaacgugaccaugcccaacaacgaggaguucgacaagcuguacaucuggggcguccaccaccccgggaccgacaacgaccagaucuuccucuacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcugaucaacagcaccgggaaccucaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggccucaucaugugggccugccagaaggggaacauccgcugcaacaucugcaucuga

SEQ ID NO: 64189 - RNA, 1701 nt, Artificial Sequence; identical to SEQ ID NO: 63442
  derived and/or modified sequence opt1 from hemagglutinin__InfluenzaA__ACU80157

SEQ ID NO: 64190 - RNA, 1698 nt, Artificial Sequence; identical to SEQ ID NO: 64178
  derived and/or modified sequence opt1 from hemagglutinin__InfluenzaA__ACU80168

SEQ ID NO: 64191 - RNA, 1701 nt, Artificial Sequence; identical to SEQ ID NO: 63442
  derived and/or modified sequence opt1 from hemagglutinin__InfluenzaA__ACU80179

SEQ ID NO: 64192 - RNA, 1701 nt, Artificial Sequence
  derived and/or modified sequence opt1 from hemagglutinin__InfluenzaA__ACU80190
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcacagcaaguucaaguaccccgcccugaacgugaccaugcccaacaacgaggaguucgacaagcuguacaucuggggcguccaccaccccgggaccgacaacgaccagaucuuccucuacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcugaucaacagcaccgggaaccucaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggaucgagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 64193 - RNA, 1701 nt, Artificial Sequence
  derived and/or modified sequence opt1 from hemagglutinin__InfluenzaA__ACU80201
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacaucaagugcaacaucugcaucuga

SEQ ID NO: 64194 - RNA, 1701 nt, Artificial Sequence; identical to SEQ ID NO: 63442
  derived and/or modified sequence opt1 from hemagglutinin__InfluenzaA__ACU80212

SEQ ID NO: 64195 - RNA, 1698 nt, Artificial Sequence
  derived and/or modified sequence opt1 from hemagglutinin__InfluenzaA__ACU80234
augaaggugaagcugcucguccugcugugcaccuucgccgccaccuacgcggacacgaucugcaucggcuaccacgccaacaacagcaccgacaccguggacaccgugcucgagaagaacgucacggugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacaccgucacggggguguccgccagcugcucccacaacggcgagagcuccuucuacaagaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccgcaaguucacccccgagaucgcgaagcggcccaaggugcgcgaccaggagggccggaucaacuacuacuggacgcuccuggagcccggggacaccaucaucuucgaggccaacggcaaccugaucgccccgcgcuacgccuucgcccucucccggggguucggcagcggcaucaucaacuccaacgcgcccauggacaagugcgacgccaagugccagacgccccagggggccaucaacagcucccugcccuuccagaacguccacccggugaccaucggcgagugccccaaguacgugcgcagcgccaagcugcggauggucaccgggcuccgcaacauccccuccauccagagccggggccuguucggggccaucgcgggcuucaucgagggcggguggaccggcaugguggacgggugguacggcuaccaccaccagaacgagcagggguccggcuacgccgccgaccagaaguccacccagaacgccaucaacggcaucaccaacaaggugaacagcgucaucgagaagaugaacacgcaguucaccgccguggggaaggaguucaacaagcuggagcgccggauggagaaccucaacaagaaggucgacgacggcuucaucgacaucuggaccuacaacgcggagcugcuggugcuccuggagaacgagcgcacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggacguacgacuaccccaaguacuccgaggagagcaagcugaaccgggagaagaucgacggcgugaagcucgaguccaugggcgucuaccagauccuggccaucuacagcaccguggccagcucccuggugcuccuggucagccugggggccaucuccuucuggaugugcagcaacggcucccuccagugccgcaucugcaucuga

SEQ ID NO: 64196 - RNA, 1701 nt, Artificial Sequence
  derived and/or modified sequence opt1 from hemagglutinin__InfluenzaA__ACU80245
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcacagcaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccuccugaucaacagcaccgggaaccugaucgccccgcggggcuacuucaagauccgcuccgggaaguccuccaucaugcggagcgacgcccccaucggccgcugcaacuccgagugcaucacgcccaacggcagcauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggguucaucgagaacggcugggagggcaugguggacgggugguacggcuuccggcaccagaacuccgaggggaucggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcaucgcccuccugggcuucaucaugugggccugccagaaggggaacauccggugcaacaucugcaucuga

SEQ ID NO: 64197 - RNA, 1701 nt, Artificial Sequence; identical to SEQ ID NO: 63545
  derived and/or modified sequence opt1 from hemagglutinin__InfluenzaA__ACU80256

SEQ ID NO: 64198 - RNA, 1698 nt, Artificial Sequence; identical to SEQ ID NO: 63496
  derived and/or modified sequence opt1 from hemagglutinin__InfluenzaA__ACU80267

SEQ ID NO: 64199 - RNA, 1698 nt, Artificial Sequence; identical to SEQ ID NO: 64178
  derived and/or modified sequence opt1 from hemagglutinin__InfluenzaA__ACU80278

SEQ ID NO: 64200 - RNA, 1701 nt, Artificial Sequence; identical to SEQ ID NO: 63442
  derived and/or modified sequence opt1 from hemagglutinin__InfluenzaA__ACU80289

SEQ ID NO: 64201 - RNA, 1701 nt, Artificial Sequence; identical to SEQ ID NO: 63545
  derived and/or modified sequence opt1 from hemagglutinin__InfluenzaA__ACU80300

SEQ ID NO: 64202 - RNA, 1701 nt, Artificial Sequence
  derived and/or modified sequence opt1 from hemagglutinin__InfluenzaA__ACU80311
augcgcaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcggagcaaggccuacuccaacugcuaccccuacgacgugccggacuacgcgagccugcgcucccuggucgccagcuccggcacgcucgaguucaacaacgagagcuucaacuggaccggggugacccagaacggcaccuccagcgccugcauccggcgcuccaacaacagcuucuucucccggcugaacuggcugacgcacagcaaguucaaguaccccgcccucaacgugaccaugcccaacaacgagaacuucgacaagcuguacaucuggggcguccaccaccccgggaccgacaacgaccagaucuuccuguacgcgcaggccuccgggcgcaucaccgugagcacgaagcggagccagcagaccgugaucccgaacaucggcucccgcccccggguccgcaacauccccagccggaucuccaucuacuggaccaucgugaagcccggcgacauccuccugaucaacagcaccgggaaccugaucgccccgcgcggcuacuucaagauccgguccgggaaguccuccaucaugcgcagcgacgcccccaucggcaagugcaacuccgagugcaucacgcccaacggcagcauccccaacgacaagccguuccagaacgugaaccggaucaccuacggggccugcccccgcuacgucaagcagaacacccucaagcuggcgaccggcaugcggaacgugcccgagaagcagacgcgcgggaucuucggcgccaucgccggguucaucgagaacggcugggagggcaugguggacgggugguacggcuuccggcaccagaacuccgaggggaucggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccuggagaaguacguggaggacaccaagaucgaccucuggagcuacaacgccgagcugcugguggcccucgagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcugaaguccggcuacaaggacuggauccucuggaucagcuucgccaucuccugcuuccugcugugcaucgcccuccugggcuucaucaugugggccugccagaaggggaacauccggugcaacaucugcaucuga

SEQ ID NO: 64203 - RNA, 1701 nt, Artificial Sequence; identical to SEQ ID NO: 63545
  derived and/or modified sequence opt1 from hemagglutinin__InfluenzaA__ACU80322

SEQ ID NO: 64204 - RNA, 1701 nt, Artificial Sequence; identical to SEQ ID NO: 63442
  derived and/or modified sequence opt1 from hemagglutinin__InfluenzaA__ACU80333

SEQ ID NO: 64205 - RNA, 1701 nt, Artificial Sequence; identical to SEQ ID NO: 63545
  derived and/or modified sequence opt1 from hemagglutinin__InfluenzaA__ACU80344

SEQ ID NO: 64206 - RNA, 1701 nt, Artificial Sequence; identical to SEQ ID NO: 63545
  derived and/or modified sequence opt1 from hemagglutinin__InfluenzaA__ACU80355

SEQ ID NO: 64207 - RNA, 1701 nt, Artificial Sequence; identical to SEQ ID NO: 63545
  derived and/or modified sequence opt1 from hemagglutinin__InfluenzaA__ACU80366

SEQ ID NO: 64208 - RNA, 1701 nt, Artificial Sequence
  derived and/or modified sequence opt1 from hemagglutinin__InfluenzaA__ACU80377
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcacagcaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccuccugaucaacagcaccgggaaccugaucgccccgcggggcuacuucaagauccgcuccgggaaguccuccaucaugcggagcgacgcccccaucggcaagugcaacuucgagugcaucacgcccaacggcuccauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcucaaccggcugaucggcaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacacgaucgaccugaccgacagcgagaugaacaagcuguucgagaagacccggaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucuccuucgccaugagcugcuuccugcugugcaucgcccuccugggcuucaucaugugggccugccagaaggggaacauccggugcaacaucugcaucuga

SEQ ID NO: 64209 - RNA, 1701 nt, Artificial Sequence; identical to SEQ ID NO: 63545
  derived and/or modified sequence opt1 from hemagglutinin__InfluenzaA__ACU80388

SEQ ID NO: 64210 - RNA, 1701 nt, Artificial Sequence; identical to SEQ ID NO: 63442
  derived and/or modified sequence opt1 from hemagglutinin__InfluenzaA__ACU80399

SEQ ID NO: 64211 - RNA, 1698 nt, Artificial Sequence
  derived and/or modified sequence opt1 from hemagglutinin__InfluenzaA__ACU80410
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaaggcccuguaccacaccgagaacgccuacgugagcgucgugagcucccacuacagccggaaguucacgcccgagaucgccaagcgccccaaggugcgggaccaggagggccgcaucaacuacuacuggacccuccuggagcccggggacaccaucaucuucgaggcgaacggcaaccugaucgccccgcgguacgccuucgcccucucccgcggguucggcagcggcaucaucaacuccaacgcccccauggacaagugcgacgcgaagugccagacgccccagggggccaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacagcaacgugaagaaccucuacgagaaggucaagaaccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggccaucuacuccaccguggccagcagccuggugcuccuggucucccugggggccaucagcuucuggaugugcuccaacggcagccuccagugccggaucugcaucuga

SEQ ID NO: 64212 - RNA, 1701 nt, Artificial Sequence
  derived and/or modified sequence opt1 from hemagglutinin__InfluenzaA__ACU80424
augaagaccaucaucgcccugagcuacauccucugccugguguucgcccagaaguuccccggcaacgacaacuccaccgcgacgcugugccucgggcaccacgccgucccgaacggcaccaucgugaagaccaucaccaacgaccagaucgaggugacgaacgccaccgagcugguccagagcuccagcaccggggagaucugcgacagcccccaccagauccuggacggcgagaacugcacccucaucgacgcccugcugggggacccccagugcgacggcuuccagaacaagaacugggaccucuucguggagcgcagcaaggccuacuccaacugcuaccccuacgacgugccggacuacgcgagccugcggucccuggucgccagcuccggcacgcucgaguucaacaacgagagcuucaacuggaccggggugacccagaacggcaccuccagcgccugcauccgccgguccaacaacagcuucuucucccgccugaacuggcugacgcacagcaaguucaaguaccccgcccucaacgugaccaugcccaacaacgagaacuucgacaagcuguacaucuggggcguccaccaccccgggaccgacaacgaccagaucuuccuguacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccuccugaucaacagcaccgggaaccugaucgccccgcggggcuacuucaagauccgcuccgggaaguccuccaucaugcggagcgacgcccccaucggcaagugcaacuucgagugcaucacgcccaacggcuccauccccaacgacaagccguuccagaacgugaaccgcaucaccuacggggccugcccccgguacgucaagcagaacacccucaagcuggcgaccggcaugcgcaacgugcccgagaagcagacgcgggggaucuucggcgccaucgccggguucaucgagaacggcugggagggcaugguggacgggugguacggcuuccgccaccagaacagcgaggggaucggccaggccgccgaccugaaguccacccaggcggccaucgaccagaucaacgggaagcucaaccggcugaucggcaagaccaacgagaaguuccaccagaucgagaaggaguucagcgaggucgagggccgcauccaggaccuggagaaguacguggaggacaccaagaucgaccucugguccuacaacgccgagcugcugguggcccucgagaaccagcacacgaucgaccugaccgacagcgagaugaacaagcuguucgagaagacccggaagcagcuccgcgagaacgccgaggacauggggaacggcugcuucaagaucuaccacaagugcgacaacgcgugcaucggguccauccgcaacggcaccuacgaccacgacgucuaccgggacgaggcccugaacaaccgcuuccagaucaaggggguggagcucaagagcggcuacaaggacuggauccuguggaucuccuucgccaucagcugcuuccugcugugcaucgcccuccugggcuucaucaugugggccugccagaaggggaacauccggugcaacaucugcaucuga

SEQ ID NO: 64213 - RNA, 1701 nt, Artificial Sequence; identical to SEQ ID NO: 64212
  derived and/or modified sequence opt1 from hemagglutinin__InfluenzaA__ACU80435

SEQ ID NO: 64214 - RNA, 1698 nt, Artificial Sequence
  derived and/or modified sequence opt1 from hemagglutinin__InfluenzaA__ACU80446
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccaacaucggcgaccagaagacccuguaccacacggagaacgccuacgugagcgucgugagcucccacuacagccggaaguucacccccgagaucgccaagcgccccaaggugcgggaccaggagggccgcaucaacuacuacuggacccuccuggagcccggggacaccaucaucuucgaggccaacggcaaccugaucgcgccgcgguacgccuucgcccucucccgcggguucggcagcggcaucaucaacuccaacgcccccauggacaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgaguccauggaggucuaccagauccuggcgaucuacagcaccguggccagcucccuggugcuccuggucagccugggcgccaucuccuucuggaugugcagcaacgggucccuccagugccggaucugcaucuga

SEQ ID NO: 64215 - RNA, 1701 nt, Artificial Sequence; identical to SEQ ID NO: 63442
  derived and/or modified sequence opt1 from hemagglutinin__InfluenzaA__ACU80458

SEQ ID NO: 64216 - RNA, 1701 nt, Artificial Sequence; identical to SEQ ID NO: 63442
  derived and/or modified sequence opt1 from hemagglutinin__InfluenzaA__ACU80470

SEQ ID NO: 64217 - RNA, 1701 nt, Artificial Sequence; identical to SEQ ID NO: 63545
  derived and/or modified sequence opt1 from hemagglutinin__InfluenzaA__ACU80600

SEQ ID NO: 64218 - RNA, 1701 nt, Artificial Sequence; identical to SEQ ID NO: 64212
  derived and/or modified sequence opt1 from hemagglutinin__InfluenzaA__ACU80611

SEQ ID NO: 64219 - RNA, 1701 nt, Artificial Sequence; identical to SEQ ID NO: 63545
  derived and/or modified sequence opt1 from hemagglutinin__InfluenzaA__ACU80622

SEQ ID NO: 64220 - RNA, 1701 nt, Artificial Sequence; identical to SEQ ID NO: 63442
  derived and/or modified sequence opt1 from hemagglutinin__InfluenzaA__ACU80633

SEQ ID NO: 64221 - RNA, 1701 nt, Artificial Sequence
  derived and/or modified sequence opt1 from hemagglutinin__InfluenzaA__ACU80644
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcacagcaaguucaaguaccccgcccugaacgugaccaugcccaacaacgaggaguucgacaagcuguacaucuggggcguccaccaccccgggaccgacaacgaccagaucuuccucuacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcugaucaacagcaccgggaaccucaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcguggcccugcugggcuucaucaugugggccugccagaaggggaacauccgcugcaacaucugcaucuga

SEQ ID NO: 64222 - RNA, 1701 nt, Artificial Sequence; identical to SEQ ID NO: 63442
  derived and/or modified sequence opt1 from hemagglutinin__InfluenzaA__ACU80655

SEQ ID NO: 64223 - RNA, 1701 nt, Artificial Sequence; identical to SEQ ID NO: 63442
  derived and/or modified sequence opt1 from hemagglutinin__InfluenzaA__ACU80666

SEQ ID NO: 64224 - RNA, 1701 nt, Artificial Sequence; identical to SEQ ID NO: 62936
  derived and/or modified sequence opt1 from hemagglutinin__InfluenzaA__ACU80677

SEQ ID NO: 64225 - RNA, 1701 nt, Artificial Sequence; identical to SEQ ID NO: 63442
  derived and/or modified sequence opt1 from hemagglutinin__InfluenzaA__ACU80688

SEQ ID NO: 64226 - RNA, 1701 nt, Artificial Sequence; identical to SEQ ID NO: 63545
  derived and/or modified sequence opt1 from hemagglutinin__InfluenzaA__ACU80699

SEQ ID NO: 64227 - RNA, 1701 nt, Artificial Sequence; identical to SEQ ID NO: 63545
  derived and/or modified sequence opt1 from hemagglutinin__InfluenzaA__ACU80710

SEQ ID NO: 64228 - RNA, 1701 nt, Artificial Sequence
  derived and/or modified sequence opt1 from hemagglutinin__InfluenzaA__ACU80721
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagacggaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggaccggggugacccagaacggcacguccagcgccugcauccgccgguccaacaacagcuucuucucccgccugaacuggcucacccaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucacgguguccaccaagcgcagccagcagaccgugaucccgaacaucggcagccggccccgcguccggaacauccccucccgcaucagcaucuacuggaccaucgugaagcccggcgacauccugcucaucaacuccacggggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucaccuacggggccugcccccgguacgucaagcagaacacccugaagcucgcgacgggcaugcgcaacgugcccgagaagcagacccgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcacguacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 64229 - RNA, 1701 nt, Artificial Sequence; identical to SEQ ID NO: 63442
  derived and/or modified sequence opt1 from hemagglutinin__InfluenzaA__ACU80732

SEQ ID NO: 64230 - RNA, 1701 nt, Artificial Sequence; identical to SEQ ID NO: 63442
  derived and/or modified sequence opt1 from hemagglutinin__InfluenzaA__ACU80743

SEQ ID NO: 64231 - RNA, 1701 nt, Artificial Sequence
  derived and/or modified sequence opt1 from hemagglutinin__InfluenzaA__ACU80754
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcgugguccugcucggcuucaucaugugggccugccagaaggggaacauccggugcaacaucugcaucuga

SEQ ID NO: 64232 - RNA, 1701 nt, Artificial Sequence
  derived and/or modified sequence opt1 from hemagglutinin__InfluenzaA__ACU80765
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcacagcaaguucaaguaccccgcccugaacgugaccaugcccaacaacgaggaguucgacaagcuguacaucuggggcguccaccaccccgggaccgacaacgaccagaucuuccucuacgcgcaggccuccgggcggaucaccgugagcacgaagcgcagccagcagaccgugaucccgaacaucggcucccggccccgcguccggaacauccccagccgcaucuccaucuacuggaccaucgugaagcccggcgacauccugcugaucaacagcaccgggaaccucaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggaucggccaggccgccgaccucaagagcacccaggcggccaucgaccagaucaacgggaagcugaaccggcugaucggcaagaccaacgagaaguuccaccagaucgagaaggaguucuccgaggucgagggccgcauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgggagaacgccgaggacauggggaacggcugcuucaagaucuaccacaagugcgacaacgcgugcaucgggagcauccgcaacggcaccuacgaccacgacgucuaccgcgacgaggcccugaacaaccgguuccagaucaaggggguggagcucaaguccggcuacaaggacuggauccuguggaucagcuucgccaucuccugcuuccugcucugcaucgcccugcugggcuucaucaugugggccugccagaaggggaacauccgcugcaacaucugcaucuga

SEQ ID NO: 64233 - RNA, 1701 nt, Artificial Sequence
  derived and/or modified sequence opt1 from hemagglutinin__InfluenzaA__ACU80787
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagaagcagacgcgggggaucuucggcgccaucgccggguucaucgagaacggcugggagggcaugauggacgggugguacggcuuccgccaccagaacagcgaggggcggggccaggccgccgaccugaaguccacccaggcggccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggccugccagaaggggaacauccggugcaacaucugcaucuga

SEQ ID NO: 64234 - RNA, 1701 nt, Artificial Sequence; identical to SEQ ID NO: 63442
  derived and/or modified sequence opt1 from hemagglutinin__InfluenzaA__ACU80798

SEQ ID NO: 64235 - RNA, 1701 nt, Artificial Sequence; identical to SEQ ID NO: 63442
  derived and/or modified sequence opt1 from hemagglutinin__InfluenzaA__ACU81103

SEQ ID NO: 64236 - RNA, 1701 nt, Artificial Sequence
  derived and/or modified sequence opt1 from hemagglutinin__InfluenzaA__ACU87270
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccgcgagggccggaugaacuacuacuggacccugaucgagcccggggacaagaucaccuucgaggcgaccggcaaccucguggugccccgcuacgccuucgccauggagcggaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcugguccuccuggagaacgagcgcacccuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggcgaucuacuccaccguggccagcagccugguccucguggugucccugggggccaucagcuucuggaugugcuccaacggcagccugcagugccgcaucugcaucuga

SEQ ID NO: 64237 - RNA, 1701 nt, Artificial Sequence; identical to SEQ ID NO: 63677
  derived and/or modified sequence opt1 from hemagglutinin__InfluenzaA__ACV04228

SEQ ID NO: 64238 - RNA, 1701 nt, Artificial Sequence; identical to SEQ ID NO: 63677
  derived and/or modified sequence opt1 from hemagglutinin__InfluenzaA__ACV04238

SEQ ID NO: 64239 - RNA, 1701 nt, Artificial Sequence
  derived and/or modified sequence opt1 from hemagglutinin__InfluenzaA__ACV04248
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaaggggaucaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcuccagccgguacuccaagaaguucaagcccgagaucgccauccgcccgaaggugcgggaccaggagggccgcaugaacuacuacuggacgcuggucgagcccggggacaagaucaccuucgaggcgaccggcaaccucguggugccccgguacgccuucgccauggagcgcaacgccgggagcggcaucaucaucuccgacacccccguccacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgugccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 64240 - RNA, 1701 nt, Artificial Sequence; identical to SEQ ID NO: 63677
  derived and/or modified sequence opt1 from hemagglutinin__InfluenzaA__ACV04258

SEQ ID NO: 64241 - RNA, 1701 nt, Artificial Sequence; identical to SEQ ID NO: 63677
  derived and/or modified sequence opt1 from hemagglutinin__InfluenzaA__ACV04268

SEQ ID NO: 64242 - RNA, 1701 nt, Artificial Sequence; identical to SEQ ID NO: 63677
  derived and/or modified sequence opt1 from hemagglutinin__InfluenzaA__ACV04278

SEQ ID NO: 64243 - RNA, 1701 nt, Artificial Sequence; identical to SEQ ID NO: 63677
  derived and/or modified sequence opt1 from hemagglutinin__InfluenzaA__ACV04288

SEQ ID NO: 64244 - RNA, 1701 nt, Artificial Sequence
  derived and/or modified sequence opt1 from hemagglutinin__InfluenzaA__ACV04298
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccgugaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 64245 - RNA, 1701 nt, Artificial Sequence; identical to SEQ ID NO: 63677
  derived and/or modified sequence opt1 from hemagglutinin__InfluenzaA__ACV04308

SEQ ID NO: 64246 - RNA, 1701 nt, Artificial Sequence
  derived and/or modified sequence opt1 from hemagglutinin__InfluenzaA__ACV04318
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacaacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64247 - RNA, 1701 nt, Artificial Sequence; identical to SEQ ID NO: 63677
  derived and/or modified sequence opt1 from hemagglutinin__InfluenzaA__ACV04328

SEQ ID NO: 64248 - RNA, 1701 nt, Artificial Sequence; identical to SEQ ID NO: 63677
  derived and/or modified sequence opt1 from hemagglutinin__InfluenzaA__ACV04338

SEQ ID NO: 64249 - RNA, 1701 nt, Artificial Sequence; identical to SEQ ID NO: 63919
  derived and/or modified sequence opt1 from hemagglutinin__InfluenzaA__ACV04358

SEQ ID NO: 64250 - RNA, 1701 nt, Artificial Sequence
  derived and/or modified sequence opt1 from hemagglutinin__InfluenzaA__ACV04368
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugccagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64251 - RNA, 1701 nt, Artificial Sequence
  derived and/or modified sequence opt1 from hemagglutinin__InfluenzaA__ACV04378
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucaucgugucccugggggccaucagcuucuggaugugcuccaacggcagccugcagugccggaucugcaucuga

SEQ ID NO: 64252 - RNA, 1701 nt, Artificial Sequence; identical to SEQ ID NO: 63919
  derived and/or modified sequence opt1 from hemagglutinin__InfluenzaA__ACV04388

SEQ ID NO: 64253 - RNA, 1701 nt, Artificial Sequence; identical to SEQ ID NO: 63677
  derived and/or modified sequence opt1 from hemagglutinin__InfluenzaA__ACV04398

SEQ ID NO: 64254 - RNA, 1701 nt, Artificial Sequence; identical to SEQ ID NO: 63921
  derived and/or modified sequence opt1 from hemagglutinin__InfluenzaA__ACV04408

SEQ ID NO: 64255 - RNA, 1701 nt, Artificial Sequence; identical to SEQ ID NO: 63677
  derived and/or modified sequence opt1 from hemagglutinin__InfluenzaA__ACV04489

SEQ ID NO: 64256 - RNA, 1701 nt, Artificial Sequence; identical to SEQ ID NO: 63677
  derived and/or modified sequence opt1 from hemagglutinin__InfluenzaA__ACV04499

SEQ ID NO: 64257 - RNA, 1701 nt, Artificial Sequence; identical to SEQ ID NO: 63857
  derived and/or modified sequence opt1 from hemagglutinin__InfluenzaA__ACV04509

SEQ ID NO: 64258 - RNA, 1701 nt, Artificial Sequence; identical to SEQ ID NO: 63677
  derived and/or modified sequence opt1 from hemagglutinin__InfluenzaA__ACV04519

SEQ ID NO: 64259 - RNA, 1701 nt, Artificial Sequence; identical to SEQ ID NO: 63677
  derived and/or modified sequence opt1 from hemagglutinin__InfluenzaA__ACV04529

SEQ ID NO: 64260 - RNA, 1701 nt, Artificial Sequence; identical to SEQ ID NO: 63677
  derived and/or modified sequence opt1 from hemagglutinin__InfluenzaA__ACV04549

SEQ ID NO: 64261 - RNA, 1701 nt, Artificial Sequence; identical to SEQ ID NO: 63677
  derived and/or modified sequence opt1 from hemagglutinin__InfluenzaA__ACV04559

SEQ ID NO: 64262 - RNA, 1701 nt, Artificial Sequence; identical to SEQ ID NO: 63677
  derived and/or modified sequence opt1 from hemagglutinin__InfluenzaA__ACV04579

SEQ ID NO: 64263 - RNA, 1701 nt, Artificial Sequence
  derived and/or modified sequence opt1 from hemagglutinin__InfluenzaA__ACV04751
auggaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcggcuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgcgagcagcucagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccugguggucccccgcuacgccuucgccauggagcggaacgccggguccggcaucaucaucagcgacacgcccgugcacaacugcaacacgaccugccagaccccgaagggcgccaucaacaccucccuccccuuccagaacauccaccccaucaccaucgggaagugccccaaguacgucaagagcaccaagcugcgccuggcgaccggccuccggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccuggacaucuggaccuacaacgccgagcuccuggugcugcucgagaacgagcgcacccuggacuaccacgacagcaacgugaagaaccuguacgagaagguccggucccagcucaagaacaacaccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcuggagagcacccggaucuaccagauccucgccaucuacuccaccgucgcgagcagccuggugcugguggucucccucggggccaucagcuucuggaugugcuccaacggcagccugcagugccgcaucugcaucuga

SEQ ID NO: 64264 - RNA, 1701 nt, Artificial Sequence
  derived and/or modified sequence opt1 from hemagglutinin__InfluenzaA__ACV04752
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgagaacccggagugcgagagccuguccaccgccagcuccuggagcuacaucguggagaccuccagcuccgacaacgggacgugcuaccccggcgacuucaucgacuacgaggagcugcgggagcagcucagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcuggugaagaagggcaacagcuaccccaagcucuccaagagcuacaucaacgacaaggggaaggaggugcugguccuguggggcauccaccaccccagcaccuccgccgaccagcagagccucuaccagaacgccgacgccuacguguucgugggguccagccgguacuccaagaaguucaagcccgagaucgccauccgcccgaagguccgggaccaggagggccgcaugaacuacuacuggacgcugguggagcccggcgacaagaucaccuucgaggcgaccgggaaccugguggucccccgguacgccuucgccauggagcgcaacgccggcagcgggaucaucaucuccgacacccccgugcacgacugcaacacgaccugccagaccccgaagggcgccaucaacaccagccuccccuuccacaacauccaccccaucacgaucggcaagugccccaaguacgugaaguccaccaagcugcggcuggcgaccgggcuccgcaacgucccgagcauccagucccggggccuguucggggccaucgccggcuucaucgagggcggguggaccggcaugguggacgggugguacggcuaccaccaccagaacgagcaggggagcggcuacgccgccgaccugaaguccacgcagaacgcgaucgacgagaucaccaacaaggugaacagcgucaucgagaagaugaacacccaguucaccgccguggggaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgcgaucuacagcaccgucgccagcucccuggugcugguggucagccucggcgccaucuccuucuggaugugcagcaacgggucccugcagugccggaucugcaucuga

SEQ ID NO: 64265 - RNA, 1701 nt, Artificial Sequence
  derived and/or modified sequence opt1 from hemagglutinin__InfluenzaA__ACV04753
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 64266 - RNA, 1701 nt, Artificial Sequence
  derived and/or modified sequence opt1 from hemagglutinin__InfluenzaA__ACV04754
auggaggccauccuggugguccuccuguacaccuucgccaccgcgaacgccgacacgcugugcaucggcuaccacgccaacaacagcaccgacaccguggacaccgugcucgagaagaacguccccgugacgcacuccgugaaccugcugaaggacaagcacaacgggaagcucugcaagcugcgcggcgucgccccgcugcaccucgggaagugcaacaucgccggcuggauccuggggaaccccgagugcgagagccuguccaccgcgagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggccgaaccacgagagcaacaagggggucaccgccgccugcccccacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcaccucccgguacagcaagaaguucaagccggagaucgccauccgccccaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacaccccggugcacgacugcaacacgaccugccagacccccaagggcgccaucaacaccucccugcccuuccagaacauccaccccaucacgaucgggaagugcccgaaguacgucaagagcaccaagcugcggcucgcgaccggccugcgcaacgugcccuccauccagagccggggcguguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggucaacuccgugaucgagaagaugaacacccaguucaccgccgucggcaaggaguucaaccaccuggagaagcgcaucgagaaccugaacaagaagguggacgacggcuuccuggacaucuggacguacaacgccgagcuccuggugcugcucgagaacgagcggacccuggacuaccacgacagcaacgucaagaaccuguacgagaaggugcgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagagcacccgcaucuaccagauccucgcgaucuacuccaccguggccagcagccuggugcuggucgugucccucggggccaucagcuucuggaugugcuccaacggcagccugcagugccggaucugcaucuga

SEQ ID NO: 64267 - RNA, 1701 nt, Artificial Sequence; identical to SEQ ID NO: 64162
  derived and/or modified sequence opt1 from hemagglutinin__InfluenzaA__ACV04755

SEQ ID NO: 64268 - RNA, 1701 nt, Artificial Sequence; identical to SEQ ID NO: 63857
  derived and/or modified sequence opt1 from hemagglutinin__InfluenzaA__ACV33084

SEQ ID NO: 64269 - RNA, 1701 nt, Artificial Sequence; identical to SEQ ID NO: 63677
  derived and/or modified sequence opt1 from hemagglutinin__InfluenzaA__ACV33094

SEQ ID NO: 64270 - RNA, 1701 nt, Artificial Sequence; identical to SEQ ID NO: 63677
  derived and/or modified sequence opt1 from hemagglutinin__InfluenzaA__ACV33104

SEQ ID NO: 64271 - RNA, 1701 nt, Artificial Sequence; identical to SEQ ID NO: 63677
  derived and/or modified sequence opt1 from hemagglutinin__InfluenzaA__ACV33114

SEQ ID NO: 64272 - RNA, 1701 nt, Artificial Sequence; identical to SEQ ID NO: 63677
  derived and/or modified sequence opt1 from hemagglutinin__InfluenzaA__ACV33124

SEQ ID NO: 64273 - RNA, 1701 nt, Artificial Sequence; identical to SEQ ID NO: 63677
  derived and/or modified sequence opt1 from hemagglutinin__InfluenzaA__ACV33134

SEQ ID NO: 64274 - RNA, 1701 nt, Artificial Sequence; identical to SEQ ID NO: 64239
  derived and/or modified sequence opt1 from hemagglutinin__InfluenzaA__ACV33144

SEQ ID NO: 64275 - RNA, 1701 nt, Artificial Sequence; identical to SEQ ID NO: 63677
  derived and/or modified sequence opt1 from hemagglutinin__InfluenzaA__ACV33154

SEQ ID NO: 64276 - RNA, 1701 nt, Artificial Sequence; identical to SEQ ID NO: 63677
  derived and/or modified sequence opt1 from hemagglutinin__InfluenzaA__ACV33164

SEQ ID NO: 64277 - RNA, 1701 nt, Artificial Sequence; identical to SEQ ID NO: 63677
  derived and/or modified sequence opt1 from hemagglutinin__InfluenzaA__ACV33174

SEQ ID NO: 64278 - RNA, 1701 nt, Artificial Sequence; identical to SEQ ID NO: 63664
  derived and/or modified sequence opt1 from hemagglutinin__InfluenzaA__ACV41981

SEQ ID NO: 64279 - RNA, 1701 nt, Artificial Sequence; identical to SEQ ID NO: 63703
  derived and/or modified sequence opt1 from hemagglutinin__InfluenzaA__ACV41991

SEQ ID NO: 64280 - RNA, 1701 nt, Artificial Sequence; identical to SEQ ID NO: 63703
  derived and/or modified sequence opt1 from hemagglutinin__InfluenzaA__ACV42001

SEQ ID NO: 64281 - RNA, 1701 nt, Artificial Sequence; identical to SEQ ID NO: 63677
  derived and/or modified sequence opt1 from hemagglutinin__InfluenzaA__ACV42008

SEQ ID NO: 64282 - RNA, 1701 nt, Artificial Sequence; identical to SEQ ID NO: 63677
  derived and/or modified sequence opt1 from hemagglutinin__InfluenzaA__ACV42018

SEQ ID NO: 64283 - RNA, 1701 nt, Artificial Sequence; identical to SEQ ID NO: 63324
  derived and/or modified sequence opt1 from hemagglutinin__InfluenzaA__ACV49501

SEQ ID NO: 64284 - RNA, 1701 nt, Artificial Sequence
  derived and/or modified sequence opt1 from hemagglutinin__InfluenzaA__ACV49512
augaagaccaucaucgcccugagcuacaucuucugccucgcccugggccaggaccugcccgggaacgacaacuccaccgcgacgcucugccugggccaccacgccgugccgaacgggacccuggucaagaccaucaccgacgaccagaucgaggugacgaacgccaccgagcucgugcagagcuccagcaccggcaagaucugcaacaacccccaccgcauccuggacgggaucgacugcacccugaucgacgcccuccugggcgacccccacugcgacgucuuccagaacgagacgugggaccuguucguggagcgguccaaggccuucagcaacugcuaccccuacgacgugccggacuacgcgucccuccgcagccuggucgccuccagcggcacccuggaguucaucaccgagggguucaccuggacgggcgugacccagaacgggggcuccaacgccugcaagcgggggcccggcagcggcuucuucucccgccucaacuggcugaccaagagcggguccaccuaccccgugcugaacgucacgaugcccaacaacgacaacuucgacaagcucuacaucuggggcgugcaccacccgagcaccaaccaggagcagaccucccuguacgugcaggccagcgggcgggucaccguguccacgcgccggagccagcagaccaucauccccaacaucgagagccgccccugggugcggggccuguccagccgcaucuccaucuacuggaccaucgucaagcccggcgacgugcucgugaucaacagcaacgggaaccugaucgcgccgcggggcuacuucaagaugcgcaccgggaaguccagcaucaugcgguccgacgcccccaucgacacgugcaucagcgagugcaucacccccaacggcuccauccccaacgacaagccguuccagaacgucaacaagaucaccuacggggccugccccaaguacgugaagcagaacacccugaagcucgccacgggcaugcgcaacgugcccgagaagcagacccggggccuguucggggccaucgcgggcuucaucgagaacgggugggagggcaugaucgacgggugguacggcuuccgccaccagaacagcgagggcaccgggcaggccgccgaccugaaguccacccaggccgccaucgaccagaucaacggcaagcucaaccgggucaucgagaagacgaacgagaaguuccaccagaucgagaaggaguucagcgagguggaggggcgcauccaggaccuggagaaguacguggaggacaccaagaucgaccugugguccuacaacgcggagcuccuggucgcccuggagaaccagcacaccaucgaccucaccgacagcgagaugaacaagcuguucgagaagacgcggcgccagcugcgggagaacgccgaggacaugggcaacgggugcuucaagaucuaccacaagugcgacaacgccugcaucgaguccauccgcaacggcaccuacgaccacgacguguaccgcgacgaggcccucaacaaccgguuccagaucaaggacgucgagcucaagagcggcuacaaggacuggauccuguggaucuccuucgcgaucagcugcuuccugcugugcguggugcugcucggguucaucaugugggccugccagcgcggcaacauccggugcaacaucugcaucuga

SEQ ID NO: 64285 - RNA, 1701 nt, Artificial Sequence; identical to SEQ ID NO: 63337
  derived and/or modified sequence opt1 from hemagglutinin__InfluenzaA__ACV49523

SEQ ID NO: 64286 - RNA, 1698 nt, Artificial Sequence
  derived and/or modified sequence opt1 from hemagglutinin__InfluenzaA__ACV49545
augaaggccaaccugcucgugcugcugugcgcccucgcggccgccgacgccgacaccaucugcaucggcuaccacgccaacaacagcaccgacacggucgacaccgugcuggagaagaacgugaccgucacccacuccgugaaccugcucgaggacagccacaacgggaagcugugccgccugaagggcaucgcgccccuccagcuggggaagugcaacaucgccggcuggcugcucgggaacccggagugcgacccccugcugcccgugcgguccuggagcuacaucgucgagacgcccaacuccgagaacggcaucugcuacccgggcgacuucaucgacuacgaggagcuccgcgagcagcugagcuccgugagcuccuucgagcgguucgagaucuuccccaaggagagcuccuggcccaaccacaacaccaacggggugaccgccgccugcagccacgagggcaaguccagcuucuaccgcaaccugcucuggcugaccgagaaggagggguccuaccccaagcugaagaacagcuacgucaacaagaagggcaaggaggugcucgugcugugggggauccaccacccgcccaacuccaaggagcagcagaaccuguaccagaacgagaacgcguacgucagcguggugacguccaacuacaaccggcgcuucacccccgagaucgccgagcggcccaagguccgcgaccaggccggccggaugaacuacuacuggacccuccugaagccgggcgacaccaucaucuucgaggccaacgggaaccugaucgcccccauguacgcguucgcccucagccgcggcuucgggagcggcaucaucacguccaacgccagcaugcacgagugcaacaccaagugccagacgccccugggcgccaucaacuccagccugcccuaccagaacauccacccggugaccaucggggagugccccaaguacgugcgguccgccaagcuccgcauggucaccggccugcggaacauccccagcauccagucccgcgggcuguucggcgcgaucgccggguucaucgagggcggcuggaccgggaugaucgacggcugguacggguaccaccaccagaacgagcagggcagcggguacgccgccgaccagaaguccacccagaacgccaucaacggcaucaccaacaaggugaacacggugaucgagaagaugaacauccaguucaccgcggucggcaaggaguucaacaagcucgagaagcggauggagaaccugaacaagaagguggacgacggguuccuggacaucuggaccuacaacgccgagcuccuggugcugcucgagaacgagcgcacccuggacuuccacgacagcaacgucaagaaccuguacgagaaggugaagucccagcucaagaacaacgccaaggagaucggcaacgggugcuucgaguucuaccacaagugcgacaacgagugcauggagagcguccggaacggcacguacgacuaccccaaguacuccgaggagagcaagcugaaccgcgagaagguggacggggugaagcuggaguccaugggcaucuaccagauccucgccaucuacagcaccgucgccuccagccuggugcugcucgugucccugggcgcgaucagcuucuggaugugcagcaacgggucccugcagugccggaucugcaucuga

SEQ ID NO: 64287 - RNA, 1701 nt, Artificial Sequence
  derived and/or modified sequence opt1 from hemagglutinin__InfluenzaA__ACV49556
augaaggcccgccugcucauccugcugugcgcccucgcggccaccgacgccgacaccaucugcaucggcuaccacgccaacaacagcacggacaccguggacaccguccuggagaagaacgugaccgugacgcacuccgucaaccugcucgaggacagccacaacgggaagcugugccggcugaagggcaucgcgccccuccagcuggggaagugcaacaucgccggcuggauccuggggaacccggagugcgacucccuccugcccgccagcuccuggagcuacaucguggagacccccaacuccaagaacggcaucugcuaccccggcgacuucaucgacuacgaggagcugcgcgagcagcucagcuccgugagcuccuucgagcgguucgagaucuucccgaaggagagcuccuggcccaagcacagcaccaccaagggggucacggccgccugcucccacgcgggcaagagcuccuucuaccgcaaccugcuguggcucaccaagaaggaggacagcuaccccaagcuguccaacagcuacgugaacaagaaggggaaggaggugcugguccucuggggcgugcaccaccccagcuccagcaaggagcagcagacccuguaccagaacgagaacgccuacguguccgucgugagcuccaacuacaaccggcgcuucaucccggagaucgccgagcggcccgaggugaaggaccaggccgggcgcaucaacuacuacuggacccugcucgagcccggcgacacgaucaucuucgaggccaacggcaaccuggucgcgcccugguacgccuucgcccugagccggggguucggcuccgggaucaucaccagcaacgccuccaugcacgagugcaacaccaagugccagaccccgcagggcgccaucaacagcucccuccccuuccagaacauccaccccgugacgaucggcgagugccccaaguacgucaagagcgcgaagcugcgcauggugaccgggcugcggaacaucccguccauccagagccgcggccucuucggggccaucgccggcuucaucgagggcggguggaccggcaugaucgacgggugguacggcuaccaccaccagaacgagcagggguccggcuacgccgccgaccagaaguccacccagaacgcgaucaacgggaucacgaacaaggugaacagcgugaucgagaagaugaacacccaguucaccgccgucggcaaggaguucaacaaccuggagaagcggauggagaaccugaacaagaagguggacgacggcuuccucgacaucuggaccuacaacgccgagcugcuggugcuccuggagaacgagcgcacgcuggacuuccacgacagcaacgucaagaaccucuacgagaaggugaagauccagcugaagaacaacgccaaggagaucgggaacggcugcuucgaguucuaccacaagugcgacaacgagugcauggaguccguccggaacgggaccuacgacuaccccaaguacagcaaggagagcaagcugaaccgcgagaagaucgacggcgugaagcucgaguccauggggguguaccagauccuggccaucuacagcaccgucgcguccagccuggugcuccuggugucccugggcgccaucagcuucuggaugugcuccaacggcagccuccagugccggaucugcaucuga

SEQ ID NO: 64288 - RNA, 1701 nt, Artificial Sequence
  derived and/or modified sequence opt1 from hemagglutinin__InfluenzaA__ACV49567
augaaggccaagcugcucauccugcugugcgcccucaccgcgaccgacgccgacacgaucugcaucggcuaccacgccaacaacagcaccgacaccguggacaccguccuggagaagaacgugacggugacccacuccgucaaccugcucgaggacagccacaacgggaagcugugccgccugaagggcaucgcgccccuccagcuggggaagugcaacaucgccggcuggauccuggggaacccggagugcgagucccuccugagcaagcgguccuggagcuacaucgccgagacccccaacuccgagaacggcgccugcuaccccggcgacuucgccgacuacgaggagcugcgcgagcagcucagcuccgugagcuccuucgagcgguucgagaucuuccccaaggagcgcagcuggccgaagcacaacaucacccgcggggugacggccgcgugcucccacgccggcaagagcuccuucuacaagaaccugcuguggcucaccgagaccgacgggagcuaccccaagcuguccaagagcuacgucaacaacaaggagaaggaggugcuggugcucuggggcguccaccaccccuccaacaucgaggaccagaagacccuguaccggaaggagaacgccuacgugagcguggucagcuccaacuacaaccggcgcuucacgcccgagaucgccgagcggccgaaggugcgcgggcaggccggccggaucaacuacuacuggacccugcucgagcccggcgacaccaucaucuucgaggcgaacgggaaccugaucgcccccugguacgccuucgcccugagccgcgacuucggcuccgggaucaucaccagcaacgccuccauggacgagugcgacacgaagugccagacgccccagggcgcgaucaacagcucccucccguuccagaacauccaccccgugaccaucggcgagugccccaaguacgucaagagcaccaagcugcggauggugaccgggcugcgcaacauccccuccauccagagccggggccucuucggggccaucgccggcuucaucgagggcggguggaccggcaugaucgacgggugguacggcuaccaccaccagaacgagcagggguccggcuacgccgccgaccagaaguccacccagaacgcgaucaacuggaucaccaacaaggugaacagcgucaucgagaagaugaacacgcaguucaccgccguggggaaggaguucaacaagcuggagaagcgcauggagaaccugaacaagaagguggacgacggcuuccucgacaucuggaccuacaacgccgagcugcugguccuccuggagaacgagcggacccuggacuuccacgacagcaacgugaagaaccucuacgagaaggugaagaaccagcugcgcaacaacgccaaggagaucggcaacgggugcuucgaguucuaccacaagugcaacaacgagugcauggaguccgucaagaacggcacguacgacuacccgaaguacagcgaggaguccaagcugaaccgggagaagaucgacggggugaagcucgagagcaugggcgucuaccagauccuggccaucuacuccaccguggcgagcagccuggugcuccuggucucccugggggccaucagcuucuggaugugcuccaacggcagccuccagugccgcaucugcaucuga

SEQ ID NO: 64289 - RNA, 1689 nt, Artificial Sequence
  derived and/or modified sequence opt1 from hemagglutinin__InfluenzaA__ACV49578
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugcggguccccgaguggagcuacaucauggagaaggagaaccccaaguacucccucugcuacccgggcagcuucaacgacuacgaggagcugaagcaccuccuguccagcgugaagcacuucgagaaggugaagauccugcccaaggaccgcuggacgcagcacaccaccaccgggggcucccgggccugcgccgucagcgggaaccccuccuucuuccgcaacaugguguggcugacgaagaagggccccaacuacccgguggcgaaggggagcuacaacaacaccuccggcgagcagaugcucaucaucuggggcguccaccaccccaucgacgaggccgagcagaucgcccuguaccagaagguggggaccuacgugagcgccuccaccagcacgcugaacaagcgguccacccccgagaucgcggcccgccccgaggucaacggccucgggagccggauggaguucuccuggacccugcuggacaugugggacaccaucaacuucgagagcacgggcaaccucguggccccggaguacggcuucaagaucuccaagcgcgggagcagcggcaucaugaagaccgaggggacccuggagaacugcgagaccaagugccagacgccccugggcgccaucaacaccacccuccccuuccacaacgugcacccccugaccaucggggagugcccgaaguacgucaaguccgagaagcuggugcucgccacgggccugcggaacgugccccagaucgagagccgcggccuguucggggcgaucgccggcuucaucgagggcggguggcaggggauggucgacggcugguacggcuaccaccacuccaacgaccaggggagcggcuacgccgccgacaaggaguccacccagaaggccuucgacgggaucaccaacaaggugaacagcgugaucgagaagaugaacacccaguucgaggcggucggcaaggaguucuccaaccucgagaagcggcuggagaaccugaacaagaagauggaggacggguuccucgacguguggacguacaacgccgagcugcuggugcucauggagaacgagcgcacccuggacuuccacgacagcaacgucaagaaccuguacgacaaggugcggaugcagcuccgcgacaacgucaaggagcugggcaacggcugcuucgaguucuaccacaagugcgacgacgagugcauggacuccgugaagaacgggaccuacgacuaccccaaguacgaggaggagagcaagcugaaccggaacgagaucaagggcgugaagcucuccagcaugggggucuaccagauccuggccaucuacgccaccguggccggcucccugagccucgcgaucaugauggccggcaucuccuucuggaugugcagcaacgggucccugcagugccgcaucugcaucuga

SEQ ID NO: 64290 - RNA, 1689 nt, Artificial Sequence; identical to SEQ ID NO: 64289
  derived and/or modified sequence opt1 from hemagglutinin__InfluenzaA__ACV49589

SEQ ID NO: 64291 - RNA, 1689 nt, Artificial Sequence
  derived and/or modified sequence opt1 from hemagglutinin__InfluenzaA__ACV49600
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacggagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccgagaucgccacgcggcccaaggugaacggccagggcgggcgcauggaguucagcuggacccuccuggacaugugggacaccaucaacuucgaguccaccggcaaccugaucgcccccgaguacggguucaagaucagcaagcggggcuccagcgggaucaugaagacggagggcacccucgagaacugcgagaccaagugccagaccccgcugggcgccaucaacacgacccugcccuuccacaacgugcacccccucaccaucggggagugccccaaguacgucaagagcgagaagcuggugcuggcgaccggccuccgcaacgugccgcagaucgagucccgggggcuguucggcgccaucgccggguucaucgagggcggcuggcaggggauggucgacggcugguacggguaccaccacagcaacgaccagggcuccggguacgccgccgacaaggagagcacgcagaaggcguucgacggcaucaccaacaaggugaacuccgugaucgagaagaugaacacccaguucgaggccgucggcaaggaguucagcaaccuggagcgccggcucgagaaccugaacaagaagauggaggacggguuccuggacguguggaccuacaacgccgagcuccuggugcugauggagaacgagcgcacgcucgacuuccacgacuccaacgucaagaaccuguacgacaaggugcggaugcagcugcgcgacaacgucaaggagcucggcaacgggugcuucgaguucuaccacaagugcgacgacgagugcaugaacagcgugaagaacggcaccuacgacuaccccaaguacgaggaggaguccaagcugaaccggaacgagaucaagggcgugaagcugagcuccaugggggucuaccagauccucgccaucuacgccaccguggcgggcagccugucccuggccaucaugauggccgggaucagcuucuggaugugcuccaacggcagccuccagugccgcaucugcaucuga

SEQ ID NO: 64292 - RNA, 1689 nt, Artificial Sequence
  derived and/or modified sequence opt1 from hemagglutinin__InfluenzaA__ACV49611
auggccaucaucuaccugauccuccuguucaccgccgugcgcggcgaccagaucugcaucggguaccacgcgaacaacagcaccgagaaggucgacacgauccuggagcggaacgugaccgugacccacgccaaggacauccucgagaagacccacaacggcaagcugugcaagcugaacgggaucccgccccucgagcugggcgacugcuccaucgccggguggcugcucggcaaccccgagugcgaccgccugcugagcguccccgagugguccuacaucauggagaaggagaacccccgggacggccucugcuacccggggagcuucaacgacuacgaggagcugaagcaccuccuguccagcgugaagcacuucgagaaggugaagauccugcccaaggaccgcuggacgcagcacaccaccaccggcgggucccgggccugcgccgucagcggcaaccccuccuucuuccgcaacaugguguggcugacggagaaggggagcaacuaccccguggcgaagggcuccuacaacaacaccagcggcgagcagaugcucaucaucuggggcguccaccacccgaacgacgagaccgagcagcggacccuguaccagaacguggggacguacguguccgucgggaccagcacccugaacaagcgcuccacccccaagaucgccacgcggcccaaggugaacggccagggcgggcgcauggaguucagcuggacccuccuggacaugugggacaccaucaacuucgaguccaccggcaaccugaucgcccccgaguacggguucaagaucagcaagcggggcuccagcgggaucaugaagacggagggcacccucgagaacugcgagaccaagugccagaccccgcugggcgccaucaacacgacccugcccuuccacaacgugcacccccucaccaucggggagugccccaaguacgucaagagcgagaagcuggugcuggcgaccggccuccgcaacgugccgcagaucgagucccgggggcuguucggcgccaucgccggguucaucgagggcggcuggcaggggauggucgacggcugguacggguaccaccacagcaacgaccagggcuccggguacgccgccgacaaggagagcacgcagaaggcguucgacggcaucaccaacaaggugaacuccgugaucgagaagaugaacacccaguucgaggccgucggcaaggaguucagcaaccuggagcgccggcucgagaaccugaacaagaagguggaggacggguuccuggacguguggaccuacaacgccgagcuccugguccugauggagaacgagcgcacgcucgacuuccacgacuccaacgugaagaaccuguacgacaagguccggaugcagcugcgcgacaacgugaaggagcucggcaacgggugcuucgaguucuaccacaagugcgacgacgagugcaugaacagcgugaagaacggcaccuacgacuaccccaaguacgaggaggaguccaagcugaaccggaacgagaucaagggcgucaagcugagcuccauggggguguaccagauccucgccaucuacgccaccguggcgggcagccugucccuggccaucaugauggccgggaucagcuucuggaugugcuccaacggcagccuccagugccgcaucugcaucuga

SEQ ID NO: 64293 - RNA, 1701 nt, Artificial Sequence
  derived and/or modified sequence opt1 from hemagglutinin__InfluenzaA__ACV49633
augaagaccaucaucgcccugagcuacauccucugccugguguucgcccagaagcugcccggcaacgacaacuccaccgcgacgcucugccuggggcaccacgccgucccgaacggcacccuggugaagaccaucaccaacgaccagaucgaggugacgaacgccaccgagcucguccagagcuccagcaccgggcgcaucugcgacagcccccaccggauccuggacggcaagaacugcacccugaucgacgcccuccugggggacccccacugcgacggcuuccagaacaaggagugggaccuguucguggagcgcagcaaggccuacuccaacugcuaccccuacgacgugccggacuacgcgagccuccggucccuggucgccagcuccggcacgcuggaguucaccaacgagggguucaacuggaccggcguggcccaggacgggaccagcuacgccugcaagcgcggcuccgugaaguccuucuucucccggcucaacuggcugcacaagcuggaguacaaguaccccgcgcucaacgucacgaugcccaacaacgacaaguucgacaagcuguacaucuggggcgugcaccaccccagcaccgacuccgugcagaccagccuguacguccaggccuccgggcgcgugaccgugagcacgaagcggagccagcagaccgucaucccgaacaucggcucccgccccugggugcgggggaucagcucccgcaucagcaucuacuggaccaucgugaagcccggcgacauccuccugaucaacuccaccgggaaccugaucgcgccccggggcuacuucaagauccgcagcggcaaguccagcaucaugcgguccgacgccccgaucgggaacugcaacagcgagugcaucacgcccaacggcuccauccccaacgacaagcccuuccagaacgucaaccgcaucaccuacggggccugcccgcgguacgugaagcagaacacccucaagcuggccaccggcaugcgcaacgugcccgagaagcagacgcgggggaucuucggcgccaucgccggcuucaucgagaacgggugggagggcauggucgacgggugguacggcuuccgccaccagaacagcgaggggaccggccaggccgccgaccugaaguccacccaggcggccaucaaccagaucaacggcaagcucaaccggcugaucgagaagaccaacgagaaguucccccagaucgagaaggaguucagcgagguggaggggcgcauccaggaccuggagaaguacguggaggacacgaagaucgaccucugguccuacaacgccgagcugcuggucgcccucgagaaccagcacaccaucgaccugaccgacagcgagaugaacaagcuguucgagcggacccgcaagcagcuccgcgagaacgccgaggacaugggcaacgggugcuucaagaucuaccacaagugcgacaacgcgugcaucggcuccauccggaacgggacguacgaccacgacguguaccgcgacgaggcccugaacaaccgguuccagaucaagggcgucgagcucaagagcggcuacaaggacuggauccuguggaucuccuucgccaucagcugcuuccugcugugcguggugcuccugggguucaucaugugggccugccagaagggcaacauccgcugcaacaucugcaucuga

SEQ ID NO: 64294 - RNA, 1701 nt, Artificial Sequence; identical to SEQ ID NO: 63364
  derived and/or modified sequence opt1 from hemagglutinin__InfluenzaA__ACV49644

SEQ ID NO: 64295 - RNA, 1698 nt, Artificial Sequence; identical to SEQ ID NO: 64183
  derived and/or modified sequence opt1 from hemagglutinin__InfluenzaA__ACV49676

SEQ ID NO: 64296 - RNA, 1701 nt, Artificial Sequence; identical to SEQ ID NO: 63664
  derived and/or modified sequence opt1 from hemagglutinin__InfluenzaA__ACV53450

SEQ ID NO: 64297 - RNA, 1701 nt, Artificial Sequence; identical to SEQ ID NO: 63664
  derived and/or modified sequence opt1 from hemagglutinin__InfluenzaA__ACV53460

SEQ ID NO: 64298 - RNA, 1701 nt, Artificial Sequence; identical to SEQ ID NO: 63664
  derived and/or modified sequence opt1 from hemagglutinin__InfluenzaA__ACV53480

SEQ ID NO: 64299 - RNA, 1701 nt, Artificial Sequence
  derived and/or modified sequence opt1 from hemagglutinin__InfluenzaA__ACV53490
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcgacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagacgcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64300 - RNA, 1701 nt, Artificial Sequence
  derived and/or modified sequence opt1 from hemagglutinin__InfluenzaA__ACV53500
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagacgcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64301 - RNA, 1701 nt, Artificial Sequence
  derived and/or modified sequence opt1 from hemagglutinin__InfluenzaA__ACV53880
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccaccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 64302 - RNA, 1701 nt, Artificial Sequence; identical to SEQ ID NO: 63677
  derived and/or modified sequence opt1 from hemagglutinin__InfluenzaA__ACV53881

SEQ ID NO: 64303 - RNA, 1701 nt, Artificial Sequence; identical to SEQ ID NO: 63664
  derived and/or modified sequence opt1 from hemagglutinin__InfluenzaA__ACV53882

SEQ ID NO: 64304 - RNA, 1701 nt, Artificial Sequence; identical to SEQ ID NO: 63677
  derived and/or modified sequence opt1 from hemagglutinin__InfluenzaA__ACV53883

SEQ ID NO: 64305 - RNA, 1701 nt, Artificial Sequence; identical to SEQ ID NO: 63677
  derived and/or modified sequence opt1 from hemagglutinin__InfluenzaA__ACV53885

SEQ ID NO: 64306 - RNA, 1701 nt, Artificial Sequence
  derived and/or modified sequence opt1 from hemagglutinin__InfluenzaA__ACV53899
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccggagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64307 - RNA, 1701 nt, Artificial Sequence; identical to SEQ ID NO: 63677
  derived and/or modified sequence opt1 from hemagglutinin__InfluenzaA__ACV53909

SEQ ID NO: 64308 - RNA, 1701 nt, Artificial Sequence; identical to SEQ ID NO: 63677
  derived and/or modified sequence opt1 from hemagglutinin__InfluenzaA__ACV67220

SEQ ID NO: 64309 - RNA, 1701 nt, Artificial Sequence
  derived and/or modified sequence opt1 from hemagglutinin__InfluenzaA__ACV67221
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcggcagccuguccaccgccagcuccuggagcuacaucguggagaccuccagcuccgacaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccaguccgccgacgccuacguguucgugggcacgagccgguacuccaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcagcggcaucaucaucuccgacacgcccgugcacgacugcaacacgaccugccagaccccgaagggggccaucaacaccagccugcccuuccagaacauccaccccaucaccaucggcaagugccccaaguacgugaaguccaccaagcugcggcucgcgaccgggcugcgcaacgucccgagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacggcucccugcagugccggaucugcaucuga

SEQ ID NO: 64310 - RNA, 1701 nt, Artificial Sequence; identical to SEQ ID NO: 63664
  derived and/or modified sequence opt1 from hemagglutinin__InfluenzaA__ACV67222

SEQ ID NO: 64311 - RNA, 1701 nt, Artificial Sequence; identical to SEQ ID NO: 63703
  derived and/or modified sequence opt1 from hemagglutinin__InfluenzaA__ACV67223

SEQ ID NO: 64312 - RNA, 1701 nt, Artificial Sequence; identical to SEQ ID NO: 63919
  derived and/or modified sequence opt1 from hemagglutinin__InfluenzaA__ACV67224

SEQ ID NO: 64313 - RNA, 1701 nt, Artificial Sequence; identical to SEQ ID NO: 63857
  derived and/or modified sequence opt1 from hemagglutinin__InfluenzaA__ACV67225

SEQ ID NO: 64314 - RNA, 1701 nt, Artificial Sequence; identical to SEQ ID NO: 63677
  derived and/or modified sequence opt1 from hemagglutinin__InfluenzaA__ACV67226

SEQ ID NO: 64315 - RNA, 1701 nt, Artificial Sequence
  derived and/or modified sequence opt1 from hemagglutinin__InfluenzaA__ACV67227
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcaacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64316 - RNA, 1701 nt, Artificial Sequence; identical to SEQ ID NO: 63919
  derived and/or modified sequence opt1 from hemagglutinin__InfluenzaA__ACV67228

SEQ ID NO: 64317 - RNA, 1701 nt, Artificial Sequence
  derived and/or modified sequence opt1 from hemagglutinin__InfluenzaA__ACV67229
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaaccccaucgacgagaucaccaacaaggugaacuccgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 64318 - RNA, 1701 nt, Artificial Sequence; identical to SEQ ID NO: 63664
  derived and/or modified sequence opt1 from hemagglutinin__InfluenzaA__ACV67230

SEQ ID NO: 64319 - RNA, 1701 nt, Artificial Sequence; identical to SEQ ID NO: 63677
  derived and/or modified sequence opt1 from hemagglutinin__InfluenzaA__ACV67231

SEQ ID NO: 64320 - RNA, 1701 nt, Artificial Sequence; identical to SEQ ID NO: 63677
  derived and/or modified sequence opt1 from hemagglutinin__InfluenzaA__ACV67232

SEQ ID NO: 64321 - RNA, 1701 nt, Artificial Sequence; identical to SEQ ID NO: 63664
  derived and/or modified sequence opt1 from hemagglutinin__InfluenzaA__ACV67233

SEQ ID NO: 64322 - RNA, 1701 nt, Artificial Sequence; identical to SEQ ID NO: 63919
  derived and/or modified sequence opt1 from hemagglutinin__InfluenzaA__ACV67234

SEQ ID NO: 64323 - RNA, 1701 nt, Artificial Sequence
  derived and/or modified sequence opt1 from hemagglutinin__InfluenzaA__ACV67235
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaacgagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64324 - RNA, 1701 nt, Artificial Sequence; identical to SEQ ID NO: 63921
  derived and/or modified sequence opt1 from hemagglutinin__InfluenzaA__ACV67236

SEQ ID NO: 64325 - RNA, 1701 nt, Artificial Sequence; identical to SEQ ID NO: 63664
  derived and/or modified sequence opt1 from hemagglutinin__InfluenzaA__ACV67238

SEQ ID NO: 64326 - RNA, 1701 nt, Artificial Sequence
  derived and/or modified sequence opt1 from hemagglutinin__InfluenzaA__ACV67239
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcaacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 64327 - RNA, 1701 nt, Artificial Sequence; identical to SEQ ID NO: 63921
  derived and/or modified sequence opt1 from hemagglutinin__InfluenzaA__ACV67240

SEQ ID NO: 64328 - RNA, 1701 nt, Artificial Sequence
  derived and/or modified sequence opt1 from hemagglutinin__InfluenzaA__ACV67241
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaacgggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64329 - RNA, 1701 nt, Artificial Sequence; identical to SEQ ID NO: 63919
  derived and/or modified sequence opt1 from hemagglutinin__InfluenzaA__ACV67242

SEQ ID NO: 64330 - RNA, 1701 nt, Artificial Sequence; identical to SEQ ID NO: 63857
  derived and/or modified sequence opt1 from hemagglutinin__InfluenzaA__ACV67244

SEQ ID NO: 64331 - RNA, 1701 nt, Artificial Sequence; identical to SEQ ID NO: 63770
  derived and/or modified sequence opt1 from hemagglutinin__InfluenzaA__ACV67246

SEQ ID NO: 64332 - RNA, 1701 nt, Artificial Sequence; identical to SEQ ID NO: 64301
  derived and/or modified sequence opt1 from hemagglutinin__InfluenzaA__ACV67247

SEQ ID NO: 64333 - RNA, 1701 nt, Artificial Sequence; identical to SEQ ID NO: 63664
  derived and/or modified sequence opt1 from hemagglutinin__InfluenzaA__ACV70073

SEQ ID NO: 64334 - RNA, 1701 nt, Artificial Sequence; identical to SEQ ID NO: 63664
  derived and/or modified sequence opt1 from hemagglutinin__InfluenzaA__ACV70093

SEQ ID NO: 64335 - RNA, 1701 nt, Artificial Sequence; identical to SEQ ID NO: 63664
  derived and/or modified sequence opt1 from hemagglutinin__InfluenzaA__ACV70103

SEQ ID NO: 64336 - RNA, 1701 nt, Artificial Sequence; identical to SEQ ID NO: 63664
  derived and/or modified sequence opt1 from hemagglutinin__InfluenzaA__ACV70113

SEQ ID NO: 64337 - RNA, 1701 nt, Artificial Sequence; identical to SEQ ID NO: 63664
  derived and/or modified sequence opt1 from hemagglutinin__InfluenzaA__ACV70123

SEQ ID NO: 64338 - RNA, 1701 nt, Artificial Sequence; identical to SEQ ID NO: 63664
  derived and/or modified sequence opt1 from hemagglutinin__InfluenzaA__ACV70154

SEQ ID NO: 64339 - RNA, 1701 nt, Artificial Sequence
  derived and/or modified sequence opt1 from hemagglutinin__InfluenzaA__ACV70164
augaaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagacccugaagggcgccaucaacaccagccugccguuccagaacauccaccccaucaccaucgggaagugccccaaguacgugaaguccaccaagcuccggcuggccaccggccugcgcaacguccccagcauccagucccggggccucuucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacagcgucaucgagaagaugaacacccaguucacggcggugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcucaaccgggaggagaucgacggcgugaagcuggaguccacccgcaucuaccagauccuggccaucuacagcaccgucgcgagcucccucgugcugguggucagccugggggccaucuccuucuggaugugcagcaacggcucccuccagugccggaucugcaucuga

SEQ ID NO: 64340 - RNA, 1701 nt, Artificial Sequence; identical to SEQ ID NO: 63664
  derived and/or modified sequence opt1 from hemagglutinin__InfluenzaA__ACV70174

SEQ ID NO: 64341 - RNA, 1701 nt, Artificial Sequence; identical to SEQ ID NO: 63664
  derived and/or modified sequence opt1 from hemagglutinin__InfluenzaA__ACV70184

SEQ ID NO: 64342 - RNA, 1701 nt, Artificial Sequence; identical to SEQ ID NO: 63664
  derived and/or modified sequence opt1 from hemagglutinin__InfluenzaA__ACV70194

SEQ ID NO: 64343 - RNA, 1701 nt, Artificial Sequence; identical to SEQ ID NO: 63664
  derived and/or modified sequence opt1 from hemagglutinin__InfluenzaA__ACV70204

SEQ ID NO: 64344 - RNA, 1701 nt, Artificial Sequence; identical to SEQ ID NO: 63664
  derived and/or modified sequence opt1 from hemagglutinin__InfluenzaA__ACV70214

SEQ ID NO: 64345 - RNA, 1701 nt, Artificial Sequence; identical to SEQ ID NO: 63664
  derived and/or modified sequence opt1 from hemagglutinin__InfluenzaA__ACV70224

SEQ ID NO: 64346 - RNA, 1701 nt, Artificial Sequence; identical to SEQ ID NO: 63664
  derived and/or modified sequence opt1 from hemagglutinin__InfluenzaA__ACV70234

SEQ ID NO: 64347 - RNA, 1701 nt, Artificial Sequence; identical to SEQ ID NO: 63664
  derived and/or modified sequence opt1 from hemagglutinin__InfluenzaA__ACV70254

SEQ ID NO: 64348 - RNA, 1701 nt, Artificial Sequence; identical to SEQ ID NO: 63664
  derived and/or modified sequence opt1 from hemagglutinin__InfluenzaA__ACV70264

SEQ ID NO: 64349 - RNA, 1701 nt, Artificial Sequence; identical to SEQ ID NO: 63664
  derived and/or modified sequence opt1 from hemagglutinin__InfluenzaA__ACV70274

SEQ ID NO: 64350 - RNA, 1701 nt, Artificial Sequence; identical to SEQ ID NO: 63664
  derived and/or modified sequence opt1 from hemagglutinin__InfluenzaA__ACV70284

SEQ ID NO: 64351 - RNA, 1701 nt, Artificial Sequence; identical to SEQ ID NO: 63664
  derived and/or modified sequence opt1 from hemagglutinin__InfluenzaA__ACV70294

SEQ ID NO: 64352 - RNA, 1701 nt, Artificial Sequence; identical to SEQ ID NO: 63664
  derived and/or modified sequence opt1 from hemagglutinin__InfluenzaA__ACV70304

SEQ ID NO: 64353 - RNA, 1701 nt, Artificial Sequence; identical to SEQ ID NO: 64339
  derived and/or modified sequence opt1 from hemagglutinin__InfluenzaA__ACV70314

SEQ ID NO: 64354 - RNA, 1701 nt, Artificial Sequence
  derived and/or modified sequence opt1 from hemagglutinin__InfluenzaA__ACV70324
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguucaccgcguccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64355 - RNA, 1701 nt, Artificial Sequence; identical to SEQ ID NO: 63664
  derived and/or modified sequence opt1 from hemagglutinin__InfluenzaA__ACV70334

SEQ ID NO: 64356 - RNA, 1701 nt, Artificial Sequence; identical to SEQ ID NO: 63664
  derived and/or modified sequence opt1 from hemagglutinin__InfluenzaA__ACV70344

SEQ ID NO: 64357 - RNA, 1701 nt, Artificial Sequence; identical to SEQ ID NO: 63664
  derived and/or modified sequence opt1 from hemagglutinin__InfluenzaA__ACV70354

SEQ ID NO: 64358 - RNA, 1701 nt, Artificial Sequence; identical to SEQ ID NO: 63664
  derived and/or modified sequence opt1 from hemagglutinin__InfluenzaA__ACV70364

SEQ ID NO: 64359 - RNA, 1701 nt, Artificial Sequence; identical to SEQ ID NO: 63664
  derived and/or modified sequence opt1 from hemagglutinin__InfluenzaA__ACV70374

SEQ ID NO: 64360 - RNA, 1701 nt, Artificial Sequence; identical to SEQ ID NO: 63664
  derived and/or modified sequence opt1 from hemagglutinin__InfluenzaA__ACV70384

SEQ ID NO: 64361 - RNA, 1701 nt, Artificial Sequence; identical to SEQ ID NO: 63664
  derived and/or modified sequence opt1 from hemagglutinin__InfluenzaA__ACV70394

SEQ ID NO: 64362 - RNA, 1701 nt, Artificial Sequence; identical to SEQ ID NO: 63664
  derived and/or modified sequence opt1 from hemagglutinin__InfluenzaA__ACV70404

SEQ ID NO: 64363 - RNA, 1701 nt, Artificial Sequence; identical to SEQ ID NO: 64339
  derived and/or modified sequence opt1 from hemagglutinin__InfluenzaA__ACV70414

SEQ ID NO: 64364 - RNA, 1701 nt, Artificial Sequence; identical to SEQ ID NO: 63664
  derived and/or modified sequence opt1 from hemagglutinin__InfluenzaA__ACV70424

SEQ ID NO: 64365 - RNA, 1701 nt, Artificial Sequence; identical to SEQ ID NO: 63664
  derived and/or modified sequence opt1 from hemagglutinin__InfluenzaA__ACV70434

SEQ ID NO: 64366 - RNA, 1701 nt, Artificial Sequence; identical to SEQ ID NO: 63664
  derived and/or modified sequence opt1 from hemagglutinin__InfluenzaA__ACV70444

SEQ ID NO: 64367 - RNA, 1701 nt, Artificial Sequence; identical to SEQ ID NO: 63664
  derived and/or modified sequence opt1 from hemagglutinin__InfluenzaA__ACV70454

SEQ ID NO: 64368 - RNA, 1701 nt, Artificial Sequence; identical to SEQ ID NO: 63664
  derived and/or modified sequence opt1 from hemagglutinin__InfluenzaA__ACV70464

SEQ ID NO: 64369 - RNA, 1701 nt, Artificial Sequence; identical to SEQ ID NO: 63664
  derived and/or modified sequence opt1 from hemagglutinin__InfluenzaA__ACV70474

SEQ ID NO: 64370 - RNA, 1701 nt, Artificial Sequence; identical to SEQ ID NO: 63664
  derived and/or modified sequence opt1 from hemagglutinin__InfluenzaA__ACV70484

SEQ ID NO: 64371 - RNA, 1701 nt, Artificial Sequence; identical to SEQ ID NO: 63664
  derived and/or modified sequence opt1 from hemagglutinin__InfluenzaA__ACV70494

SEQ ID NO: 64372 - RNA, 1701 nt, Artificial Sequence; identical to SEQ ID NO: 63664
  derived and/or modified sequence opt1 from hemagglutinin__InfluenzaA__ACV70504

SEQ ID NO: 64373 - RNA, 1701 nt, Artificial Sequence; identical to SEQ ID NO: 63664
  derived and/or modified sequence opt1 from hemagglutinin__InfluenzaA__ACV70514

SEQ ID NO: 64374 - RNA, 1701 nt, Artificial Sequence; identical to SEQ ID NO: 63664
  derived and/or modified sequence opt1 from hemagglutinin__InfluenzaA__ACV70524

SEQ ID NO: 64375 - RNA, 1701 nt, Artificial Sequence; identical to SEQ ID NO: 63857
  derived and/or modified sequence opt1 from hemagglutinin__InfluenzaA__ACV70534

SEQ ID NO: 64376 - RNA, 1701 nt, Artificial Sequence; identical to SEQ ID NO: 63664
  derived and/or modified sequence opt1 from hemagglutinin__InfluenzaA__ACV70544

SEQ ID NO: 64377 - RNA, 1701 nt, Artificial Sequence; identical to SEQ ID NO: 63664
  derived and/or modified sequence opt1 from hemagglutinin__InfluenzaA__ACV70564

SEQ ID NO: 64378 - RNA, 1701 nt, Artificial Sequence; identical to SEQ ID NO: 63664
  derived and/or modified sequence opt1 from hemagglutinin__InfluenzaA__ACV70584

SEQ ID NO: 64379 - RNA, 1701 nt, Artificial Sequence; identical to SEQ ID NO: 64339
  derived and/or modified sequence opt1 from hemagglutinin__InfluenzaA__ACV70594

SEQ ID NO: 64380 - RNA, 1701 nt, Artificial Sequence; identical to SEQ ID NO: 63664
  derived and/or modified sequence opt1 from hemagglutinin__InfluenzaA__ACV70604

SEQ ID NO: 64381 - RNA, 1701 nt, Artificial Sequence; identical to SEQ ID NO: 63664
  derived and/or modified sequence opt1 from hemagglutinin__InfluenzaA__ACV70614

SEQ ID NO: 64382 - RNA, 1701 nt, Artificial Sequence; identical to SEQ ID NO: 63664
  derived and/or modified sequence opt1 from hemagglutinin__InfluenzaA__ACV70624

SEQ ID NO: 64383 - RNA, 1701 nt, Artificial Sequence; identical to SEQ ID NO: 63664
  derived and/or modified sequence opt1 from hemagglutinin__InfluenzaA__ACV70634

SEQ ID NO: 64384 - RNA, 1701 nt, Artificial Sequence; identical to SEQ ID NO: 63664
  derived and/or modified sequence opt1 from hemagglutinin__InfluenzaA__ACV70644

SEQ ID NO: 64385 - RNA, 1701 nt, Artificial Sequence; identical to SEQ ID NO: 63664
  derived and/or modified sequence opt1 from hemagglutinin__InfluenzaA__ACV70654

SEQ ID NO: 64386 - RNA, 1701 nt, Artificial Sequence; identical to SEQ ID NO: 63664
  derived and/or modified sequence opt1 from hemagglutinin__InfluenzaA__ACV70664

SEQ ID NO: 64387 - RNA, 1701 nt, Artificial Sequence; identical to SEQ ID NO: 63664
  derived and/or modified sequence opt1 from hemagglutinin__InfluenzaA__ACV70674

SEQ ID NO: 64388 - RNA, 1701 nt, Artificial Sequence; identical to SEQ ID NO: 63664
  derived and/or modified sequence opt1 from hemagglutinin__InfluenzaA__ACV70684

SEQ ID NO: 64389 - RNA, 1701 nt, Artificial Sequence; identical to SEQ ID NO: 63664
  derived and/or modified sequence opt1 from hemagglutinin__InfluenzaA__ACV70694

SEQ ID NO: 64390 - RNA, 1701 nt, Artificial Sequence; identical to SEQ ID NO: 63664
  derived and/or modified sequence opt1 from hemagglutinin__InfluenzaA__ACV70704

SEQ ID NO: 64391 - RNA, 1701 nt, Artificial Sequence; identical to SEQ ID NO: 63664
  derived and/or modified sequence opt1 from hemagglutinin__InfluenzaA__ACV70714

SEQ ID NO: 64392 - RNA, 1701 nt, Artificial Sequence; identical to SEQ ID NO: 63664
  derived and/or modified sequence opt1 from hemagglutinin__InfluenzaA__ACV70724

SEQ ID NO: 64393 - RNA, 1701 nt, Artificial Sequence; identical to SEQ ID NO: 64301
  derived and/or modified sequence opt1 from hemagglutinin__InfluenzaA__ACV70734

SEQ ID NO: 64394 - RNA, 1701 nt, Artificial Sequence; identical to SEQ ID NO: 63664
  derived and/or modified sequence opt1 from hemagglutinin__InfluenzaA__ACV70744

SEQ ID NO: 64395 - RNA, 1701 nt, Artificial Sequence; identical to SEQ ID NO: 63664
  derived and/or modified sequence opt1 from hemagglutinin__InfluenzaA__ACV70754

SEQ ID NO: 64396 - RNA, 1701 nt, Artificial Sequence; identical to SEQ ID NO: 63664
  derived and/or modified sequence opt1 from hemagglutinin__InfluenzaA__ACV70764

SEQ ID NO: 64397 - RNA, 1701 nt, Artificial Sequence; identical to SEQ ID NO: 63664
  derived and/or modified sequence opt1 from hemagglutinin__InfluenzaA__ACV70784

SEQ ID NO: 64398 - RNA, 1701 nt, Artificial Sequence
  derived and/or modified sequence opt1 from hemagglutinin__InfluenzaA__ACV70794
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggccaccgccgccugcccgcacgcgggcgccaagggguucuacaagaaccugaucuggcucgucaagaagggcaacuccuaccccaagcugagcaaguccuacaucaacgacaaggggaaggaggugcuggugcucuggggcauccaccaccccagcaccagcgccgaccagcagucccuguaccagaacgccgacgccuacgucuucgugggcagcucccgguacagcaagaaguucaagcccgagaucgcgauccgcccgaaggugcgggaccaggaggggcgcaugaacuacuacuggacgcuggucgagcccggcgacaagaucaccuucgaggccaccgggaaccucguggugccccgguacgccuucgccauggagcgcaacgccggcuccggcaucaucaucagcgacacccccguccacgacugcaacacgaccugccagaccccgaagggggcgaucaacaccucccugcccuuccagaacauccaccccaucacgaucggcaagugccccaaguacgucaagagcaccaagcugcggcucgccaccgggcugcgcaacgugccguccauccagagccggggccuguucggggccaucgccggcuucaucgagggcggguggaccggcaugguggacgggugguacggcuaccaccaccagaacgagcagggguccggcuacgccgcggaccucaagagcacgcagaacgccaucgacgagaucaccaacaaggugaacuccgugaucgagaagaugaacacccaguucaccgccgucggcaaggaguucaaccaccuggagaagcgcaucgagaaccugaacaagaagguggacgacggguuccucgacaucuggacguacaacgccgagcugcugguccuccuggagaacgagcggacccuggacuaccacgacagcaacgugaagaaccucuacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggcgaagcugaaccgggaggagaucgacggggugaagcucgagagcacccgcaucuaccagauccuggccaucuacuccaccguggccagcagccugguccucguggugucccugggcgccaucagcuucuggaugugcuccaacggcagccugcagugccggaucugcaucuga

SEQ ID NO: 64399 - RNA, 1701 nt, Artificial Sequence; identical to SEQ ID NO: 63664
  derived and/or modified sequence opt1 from hemagglutinin__InfluenzaA__ACV70804

SEQ ID NO: 64400 - RNA, 1701 nt, Artificial Sequence; identical to SEQ ID NO: 64339
  derived and/or modified sequence opt1 from hemagglutinin__InfluenzaA__ACV70824

SEQ ID NO: 64401 - RNA, 1701 nt, Artificial Sequence; identical to SEQ ID NO: 63664
  derived and/or modified sequence opt1 from hemagglutinin__InfluenzaA__ACV70834

SEQ ID NO: 64402 - RNA, 1701 nt, Artificial Sequence
  derived and/or modified sequence opt1 from hemagglutinin__InfluenzaA__ACV70844
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaagggguucuacaagaaccugaucuggcucgugaagaagggcaacuccuaccccaagcugagcaaguccuacaucaacgacaaggggaaggaggugcugguccucuggggcauccaccaccccagcaccagcgccgaccagcagucccuguaccagaacgccgacgccuacguguucgugggcagcucccgguacagcaagaaguucaagcccgagaucgccauccgcccgaagguccgggaccaggaggggcgcaugaacuacuacuggacgcugguggagcccggcgacaagaucaccuucgaggcgaccgggaaccuccuggugccccgguacgccuucgccauggagcgcaacgccggcuccggcaucaucaucagcgacacccccguccacgacugcaacacgaccugccagaccccgaagggggccaucaacaccucccugcccuuccagaacauccaccccaucacgaucggcaagugccccaaguacgucaagagcaccaagcuccggcuggcgaccgggcugcgcaacgugccguccauccagagccggggccucuucggggccaucgccggcuucaucgagggcggguggaccggcaugguggacgggugguacggcuaccaccaccagaacgagcagggguccggcuacgccgccgaccucaagagcacgcagaacgcgaucgacgagaucaccaacaaggugaacuccgugaucgagaagaugaacacccaguucaccgccgucggcaaggaguucaaccaccuggagaagcgcaucgagaaccugaacaagaagguggacgacggguuccuggacaucuggacguacaacgccgagcugcucguccugcuggagaacgagcggacccucgacuaccacgacagcaacgugaagaaccuguacgagaaggugcgcucccagcugaagaacaacgccaaggagaucggcaacgggugcuucgaguucuaccacaagugcgacaacacgugcauggagagcgucaagaacggcaccuacgacuaccccaaguacuccgaggaggccaagcucaaccgggaggagaucgacggggugaagcuggagagcacccgcaucuaccagauccuggcgaucuacuccaccguggccagcagccucguccugguggugucccugggcgccaucagcuucuggaugugcuccaacggcagccuccagugccggaucugcaucuga

SEQ ID NO: 64403 - RNA, 1701 nt, Artificial Sequence; identical to SEQ ID NO: 63664
  derived and/or modified sequence opt1 from hemagglutinin__InfluenzaA__ACV70854

SEQ ID NO: 64404 - RNA, 1701 nt, Artificial Sequence
  derived and/or modified sequence opt1 from hemagglutinin__InfluenzaA__ACV70864
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaccagcuaccccaagcuguccaagagcuacaucaacgacaagggcaaggaggugcugguccucugggggauccaccaccccagcacguccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64405 - RNA, 1701 nt, Artificial Sequence; identical to SEQ ID NO: 63664
  derived and/or modified sequence opt1 from hemagglutinin__InfluenzaA__ACV70874

SEQ ID NO: 64406 - RNA, 1701 nt, Artificial Sequence; identical to SEQ ID NO: 63857
  derived and/or modified sequence opt1 from hemagglutinin__InfluenzaA__ACV70884

SEQ ID NO: 64407 - RNA, 1701 nt, Artificial Sequence
  derived and/or modified sequence opt1 from hemagglutinin__InfluenzaA__ACV70904
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacaucccgagcauccagucccgggggcuguucggcgccaucgccggguucaucgagggcggcuggaccgggauggucgacggcugguacggguaccaccaccagaacgagcagggcagcggguacgccgccgaccucaaguccacgcagaacgcgaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 64408 - RNA, 1701 nt, Artificial Sequence; identical to SEQ ID NO: 63664
  derived and/or modified sequence opt1 from hemagglutinin__InfluenzaA__ACV70914

SEQ ID NO: 64409 - RNA, 1701 nt, Artificial Sequence; identical to SEQ ID NO: 63664
  derived and/or modified sequence opt1 from hemagglutinin__InfluenzaA__ACV70924

SEQ ID NO: 64410 - RNA, 1701 nt, Artificial Sequence; identical to SEQ ID NO: 63664
  derived and/or modified sequence opt1 from hemagglutinin__InfluenzaA__ACV70934

SEQ ID NO: 64411 - RNA, 1701 nt, Artificial Sequence; identical to SEQ ID NO: 63664
  derived and/or modified sequence opt1 from hemagglutinin__InfluenzaA__ACV70944

SEQ ID NO: 64412 - RNA, 1701 nt, Artificial Sequence
  derived and/or modified sequence opt1 from hemagglutinin__InfluenzaA__ACV70954
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccuccuggugccccgguacgccuucgccauggagcgcaacgccgggagcggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcuccggcuggcgaccggccugcgcaacgugccgagcauccagucccggggccucuucggggccaucgccggguucaucgagggcggcuggaccgggauggucgacggcugguacggguaccaccaccagaacgagcagggcagcggguacgccgccgaccugaaguccacgcagaacgcgaucgacgagaucaccaacaaggugaacagcgugaucgagaagaugaacacccaguucaccgccgucggcaaggaguucaaccaccuggagaagcgcaucgagaaccucaacaagaagguggacgacggcuuccuggacaucuggacguacaacgccgagcugcucguccugcuggagaacgagcggacccucgacuaccacgacuccaacgugaagaaccuguacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcucaaccgggaggagaucgacggcgugaagcuggaguccacccgcaucuaccagauccuggcgaucuacagcaccguggccagcucccucguccugguggugagccugggggccaucuccuucuggaugugcagcaacggcucccuccagugccggaucugcaucuga

SEQ ID NO: 64413 - RNA, 1701 nt, Artificial Sequence; identical to SEQ ID NO: 63664
  derived and/or modified sequence opt1 from hemagglutinin__InfluenzaA__ACV70964

SEQ ID NO: 64414 - RNA, 1701 nt, Artificial Sequence; identical to SEQ ID NO: 63664
  derived and/or modified sequence opt1 from hemagglutinin__InfluenzaA__ACV70974

SEQ ID NO: 64415 - RNA, 1701 nt, Artificial Sequence; identical to SEQ ID NO: 64407
  derived and/or modified sequence opt1 from hemagglutinin__InfluenzaA__ACV70984

SEQ ID NO: 64416 - RNA, 1701 nt, Artificial Sequence; identical to SEQ ID NO: 64412
  derived and/or modified sequence opt1 from hemagglutinin__InfluenzaA__ACV70994

SEQ ID NO: 64417 - RNA, 1701 nt, Artificial Sequence; identical to SEQ ID NO: 63664
  derived and/or modified sequence opt1 from hemagglutinin__InfluenzaA__ACV71004

SEQ ID NO: 64418 - RNA, 1701 nt, Artificial Sequence
  derived and/or modified sequence opt1 from hemagglutinin__InfluenzaA__ACV82230
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagccaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccaggcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugauccccaacaucggcagccggccgcgcguccggaacauccccucccgcaucagcaucuacuggaccaucgugaagcccggcgacauccugcucaucaacuccaccgggaaccugaucgcgccccggggcuacuucaagauccagagcgggaaguccagcaucaugcgcuccgacgccccgaucggcaagugcaacagcgagugcaucacgcccaacggcuccauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 64419 - RNA, 1701 nt, Artificial Sequence
  derived and/or modified sequence opt1 from hemagglutinin__InfluenzaA__ACV82232
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcaggccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacccccaacggcuccauccccaacgacaagccguuccagaacgugaaccgcaucacguacggggcgugcccccgguacgucaagcagaacacccugaagcucgccaccggcaugcgcaacgugcccgagaagcagacccgggggaucuucggcgccaucgccggguucaucgagaacggcugggagggcaugguggacgggugguacggcuuccgccaccagaacagcgaggggcggggccaggccgcggaccugaaguccacgcaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacaccaucgaccucacggacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 64420 - RNA, 1698 nt, Artificial Sequence
  derived and/or modified sequence opt1 from hemagglutinin__InfluenzaA__ACV82233
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacaaccacaacgggaagcucugccugcugaagggcaucgcgccccuccagcuggggaacugcagcgucgccggcuggauccuggggaacccggagugcgagcuccugaucuccaaggagagcugguccuacaucguggagaagcccaaccccgagaacgggaccugcuaccccggccacuucgccgacuacgaggagcugcgcgagcagcucagcuccgugagcuccuucgagcgguucgagaucuucccgaaggagagcuccuggcccaaccacacggucaccggggugagcgccuccugcagccacaacggcgagaacuccuucuaccgcaaccugcuguggcucaccgggaagaacggccuguaccccaaccugagcaaguccuacgccaacaacaaggagaaggaggugcucguccuguggggcgugcaccacccgcccaacaucgccgaccagaagacccuguaccacacggagaacgccuacgugagcgucguguccagccacuacagccggaaguucacccccgagaucgccaagcgccccaagauccgggaccaggagggccgcaucaacuacuacuggacccuccuggagcccggcgacaccaucaucuucgaggcgaacgggaaccugaucgccccgcgguacgccuucgcccucucccgcggcuucgggagcggcaucaucaacuccaacgcccccauggacaagugcgacgcgaagugccagacgccccagggcgccaucaacagcucccugcccuuccagaacgugcacccggucaccaucggggagugccccaaguacgugcggagcgccaagcugcgcauggugaccggccuccggaacauccccuccauccagagccgcgggcuguucggcgccaucgccggguucaucgagggcggcuggaccgggauggucgacggcugguacggguaccaccaccagaacgagcagggcuccggguacgcggccgaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgccgagcugcugguccuccuggagaacgagcggacccuggacuuccacgacagcaacgugaagaaccucuacgagaaggugaagucccagcugaagaacaacgcgaaggagaucggcaacgggugcuucgaguucuaccacaagugcaacgacgagugcauggagagcgucaagaacggcaccuacgacuaccccaaguacuccgaggagagcaagcugaaccgcgagaagaucgacggggugaagcucgaguccaugggcguguaccagauccuggccaucuacagcaccgucgccuccagccuggugcuccuggugagccugggcgccaucuccuucuggaugugcagcaacgggucccuccagugccggaucugcaucuga

SEQ ID NO: 64421 - RNA, 1701 nt, Artificial Sequence
  derived and/or modified sequence opt1 from hemagglutinin__InfluenzaA__ACV83662
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccgcgagggccggaugaacuacuacuggacccugguggagcccggggacaagaucaccuucgaggcgaccggcaaccucguggucccccgcuacgccuucgccauggugcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcggaucgagaaccugaacaagaagguggacgacggcuuccucgacaucuggaccuacaacgccgagcugcuggugcuccuggagaacgagcgcacccuggacuaccacgacagcaacgucaagaaccucuacgagaaggugcggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgucaagcucgagagcacccggaucuaccagauccuggcgaucuacuccaccguggccagcagccuggugcucgucgugucccugggggccaucagcuucuggaugugcuccaacggcagccugcagugccgcaucugcaucuga

SEQ ID NO: 64422 - RNA, 1701 nt, Artificial Sequence
  derived and/or modified sequence opt1 from hemagglutinin__InfluenzaA__ACV83663
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggggccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 64423 - RNA, 1701 nt, Artificial Sequence; identical to SEQ ID NO: 64422
  derived and/or modified sequence opt1 from hemagglutinin__InfluenzaA__ACV83664

SEQ ID NO: 64424 - RNA, 1701 nt, Artificial Sequence
  derived and/or modified sequence opt1 from hemagglutinin__InfluenzaA__ACV83665
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccaucgccgaccagcagucccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccacaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64425 - RNA, 1701 nt, Artificial Sequence
  derived and/or modified sequence opt1 from hemagglutinin__InfluenzaA__ACV83667
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccggaaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64426 - RNA, 1701 nt, Artificial Sequence; identical to SEQ ID NO: 63677
  derived and/or modified sequence opt1 from hemagglutinin__InfluenzaA__ACV83668

SEQ ID NO: 64427 - RNA, 1701 nt, Artificial Sequence; identical to SEQ ID NO: 63677
  derived and/or modified sequence opt1 from hemagglutinin__InfluenzaA__ACV83670

SEQ ID NO: 64428 - RNA, 1701 nt, Artificial Sequence; identical to SEQ ID NO: 63919
  derived and/or modified sequence opt1 from hemagglutinin__InfluenzaA__ACV83671

SEQ ID NO: 64429 - RNA, 1701 nt, Artificial Sequence; identical to SEQ ID NO: 64239
  derived and/or modified sequence opt1 from hemagglutinin__InfluenzaA__ACV88399

SEQ ID NO: 64430 - RNA, 1701 nt, Artificial Sequence; identical to SEQ ID NO: 64239
  derived and/or modified sequence opt1 from hemagglutinin__InfluenzaA__ACV88409

SEQ ID NO: 64431 - RNA, 1701 nt, Artificial Sequence; identical to SEQ ID NO: 63664
  derived and/or modified sequence opt1 from hemagglutinin__InfluenzaA__ACV88419

SEQ ID NO: 64432 - RNA, 1698 nt, Artificial Sequence; identical to SEQ ID NO: 64286
  derived and/or modified sequence opt1 from hemagglutinin__InfluenzaA__ACV89502

SEQ ID NO: 64433 - RNA, 1701 nt, Artificial Sequence
  derived and/or modified sequence opt1 from hemagglutinin__InfluenzaA__ACV89516
augaaggcccgccugcucauccugcugugcgcccucgcggccaccgacgccgacaccaucugcaucggcuaccacgccaacaacagcacggacaccguggacaccguccuggagaagaacgugaccgugacgcacuccgucaaccugcucgaggacagccacaacgggaagcugugccggcugaagggcaucgcgccccuccagcuggggaagugcaacaucgccggcuggauccuggggaacccggagugcgacucccuccugcccgccagcuccuggagcuacaucguggagacccccaacuccaagaacggcaucugcuaccccggcgacuucaucgacuacgaggagcugcgcgagcagcucagcuccgugagcuccuucgagcgguucgagaucuucccgaaggagagcuccuggcccaagcacagcaccaccaagggggucacggccgccugcucccacgcgggcaagagcuccuucuaccgcaaccugcuguggcucaccaagaagggggacagcuaccccaagcuguccaacagcuacgugaacaagaagggcaaggaggugcugguccucuggggcgugcaccaccccagcuccagcaaggagcagcagacccuguaccagaacgagaacgccuacguguccgucgugagcuccaacuacaaccggcgcuucaucccggagaucgccgagcggcccgaggugaaggaccaggccgggcgcaucaacuacuacuggacccugcucgagcccggcgacacgaucaucuucgaggccaacgggaaccuggucgcgcccugguacgccuucgcccugagccggggcuucggguccggcaucaucaccagcaacgccuccaugcacgagugcaacaccaagugccagaccccgcagggcgccaucaacagcucccuccccuuccagaacauccaccccgugacgaucggggagugccccaaguacgucaagagcgcgaagcugcgcauggugaccggccugcggaacaucccguccauccagagccgcggccucuucggggccaucgccggguucaucgagggcggcuggaccgggaugaucgacggcugguacggguaccaccaccagaacgagcagggcuccggguacgccgccgaccagaaguccacccagaacgcgaucaacggcaucacgaacaaggugaacagcgugaucgagaagaugaacacccaguucaccgccgucggcaaggaguucaacaaccuggagaagcggauggagaaccugaacaagaagguggacgacggguuccucgacaucuggaccuacaacgccgagcugcuggugcuccuggagaacgagcgcacgcuggacuuccacgacagcaacgucaagaaccucuacgagaaggugaagauccagcugaagaacaacgccaaggagaucggcaacgggugcuucgaguucuaccacaagugcgacaacgagugcauggaguccguccggaacggcaccuacgacuaccccaaguacagcaaggagagcaagcugaaccgcgagaagaucgacggggugaagcucgaguccaugggcguguaccagauccuggccaucuacagcaccgucgcguccagccuggugcuccuggugucccugggcgccaucagcuucuggaugugcuccaacgggagccuccagugccggaucugcaucuga

SEQ ID NO: 64434 - RNA, 1698 nt, Artificial Sequence
  derived and/or modified sequence opt1 from hemagglutinin__InfluenzaA__ACV90512
augaacgugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgcccccaucgacaagugggacgcgaagugccagacgccccagggcgccaucaacuccagccugcccuuccagaacguccacccggugaccaucggggaguggcccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaagaugaacagcgugaucgagaagaugaacacccaguucaccgccgucggcaaggaguucaacaagcuggagcggcgcauggagaaccucaacaagaagguggacgacggguucaucgacaucuggacguacaacgccgagcugcugguccuccuggagaacgagcggacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugacccucgagagcaugggcguguaccagauccuggccaucuacuccacggucgccagcagccuggugcuccuggugucccugggcgccaucagcuucuggaugugcuccaacgggagccuccagugccggaucugcaucuga

SEQ ID NO: 64435 - RNA, 1701 nt, Artificial Sequence; identical to SEQ ID NO: 63677
  derived and/or modified sequence opt1 from hemagglutinin__InfluenzaA__ACV91672

SEQ ID NO: 64436 - RNA, 1701 nt, Artificial Sequence; identical to SEQ ID NO: 63677
  derived and/or modified sequence opt1 from hemagglutinin__InfluenzaA__ACV91676

SEQ ID NO: 64437 - RNA, 1701 nt, Artificial Sequence; identical to SEQ ID NO: 63677
  derived and/or modified sequence opt1 from hemagglutinin__InfluenzaA__ACV91680

SEQ ID NO: 64438 - RNA, 1701 nt, Artificial Sequence
  derived and/or modified sequence opt1 from hemagglutinin__InfluenzaA__ACX31591
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccaggcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgugauccccaacaucggcagccggccgcgcguccggaacauccccucccgcaucagcaucuacuggaccaucgugaagcccggcgacauccugcucaucaacuccaccgggaaccugaucgcgccccggggcuacuucaagauccagagcgggaaguccagcaucaugcgcuccgacgccccgaucggcaagugcaacagcgagugcaucacgcccaacggcuccauccccaacgacaagcccuuccagaacgugaaccggaucaccuacggggccugcccgcgcuacgucaagcagaacacccugaagcucgccaccggcaugcggaacgugcccgagaagcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 64439 - RNA, 1701 nt, Artificial Sequence
  derived and/or modified sequence opt1 from hemagglutinin__InfluenzaA__ACX31933
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucaacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 64440 - RNA, 1701 nt, Artificial Sequence
  derived and/or modified sequence opt1 from hemagglutinin__InfluenzaA__ACX31934
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucaccauccgcccgaagguccggggccaggaggggcgcaugaacuacuacuggacccugguggagcccggcgacaagaucaccuucgaggccacggggaaccucguggucccccgguacgcguucgccauggagcgcaacgccggcuccggcaucaucaucagcgacacccccgugcacgacugcaacacgaccugccagaccccgaagggggccaucaacaccucccugcccuuccagaacauccaccccaucaccaucggcaagugccccaaguacgucaagagcaccaagcugcggcucgccacggggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggccaucuacuccaccgucgcgagcagccuggugcucguggucucccugggcgccaucagcuucuggaugugcuccaacggcagccugcagugccggaucugcaucuga

SEQ ID NO: 64441 - RNA, 1701 nt, Artificial Sequence; identical to SEQ ID NO: 63677
  derived and/or modified sequence opt1 from hemagglutinin__InfluenzaA__ACX31935

SEQ ID NO: 64442 - RNA, 1701 nt, Artificial Sequence; identical to SEQ ID NO: 63677
  derived and/or modified sequence opt1 from hemagglutinin__InfluenzaA__ACX31936

SEQ ID NO: 64443 - RNA, 1701 nt, Artificial Sequence; identical to SEQ ID NO: 63768
  derived and/or modified sequence opt1 from hemagglutinin__InfluenzaA__ACX31939

SEQ ID NO: 64444 - RNA, 1701 nt, Artificial Sequence; identical to SEQ ID NO: 63768
  derived and/or modified sequence opt1 from hemagglutinin__InfluenzaA__ACX31940

SEQ ID NO: 64445 - RNA, 1701 nt, Artificial Sequence; identical to SEQ ID NO: 63677
  derived and/or modified sequence opt1 from hemagglutinin__InfluenzaA__ACX31943

SEQ ID NO: 64446 - RNA, 1701 nt, Artificial Sequence; identical to SEQ ID NO: 63677
  derived and/or modified sequence opt1 from hemagglutinin__InfluenzaA__ACX31946

SEQ ID NO: 64447 - RNA, 1701 nt, Artificial Sequence; identical to SEQ ID NO: 63677
  derived and/or modified sequence opt1 from hemagglutinin__InfluenzaA__ACX31947

SEQ ID NO: 64448 - RNA, 1701 nt, Artificial Sequence; identical to SEQ ID NO: 63677
  derived and/or modified sequence opt1 from hemagglutinin__InfluenzaA__ACX31948

SEQ ID NO: 64449 - RNA, 1701 nt, Artificial Sequence
  derived and/or modified sequence opt1 from hemagglutinin__InfluenzaA__ACX31949
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacuacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgaggagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64450 - RNA, 1701 nt, Artificial Sequence; identical to SEQ ID NO: 63677
  derived and/or modified sequence opt1 from hemagglutinin__InfluenzaA__ACX31950

SEQ ID NO: 64451 - RNA, 1701 nt, Artificial Sequence; identical to SEQ ID NO: 63677
  derived and/or modified sequence opt1 from hemagglutinin__InfluenzaA__ACX31951

SEQ ID NO: 64452 - RNA, 1701 nt, Artificial Sequence; identical to SEQ ID NO: 63677
  derived and/or modified sequence opt1 from hemagglutinin__InfluenzaA__ACX31954

SEQ ID NO: 64453 - RNA, 1701 nt, Artificial Sequence; identical to SEQ ID NO: 63677
  derived and/or modified sequence opt1 from hemagglutinin__InfluenzaA__ACX31955

SEQ ID NO: 64454 - RNA, 1701 nt, Artificial Sequence; identical to SEQ ID NO: 63664
  derived and/or modified sequence opt1 from hemagglutinin__InfluenzaA__ACX31956

SEQ ID NO: 64455 - RNA, 1701 nt, Artificial Sequence; identical to SEQ ID NO: 63677
  derived and/or modified sequence opt1 from hemagglutinin__InfluenzaA__ACX31957

SEQ ID NO: 64456 - RNA, 1701 nt, Artificial Sequence; identical to SEQ ID NO: 63664
  derived and/or modified sequence opt1 from hemagglutinin__InfluenzaA__ACX31958

SEQ ID NO: 64457 - RNA, 1701 nt, Artificial Sequence; identical to SEQ ID NO: 63919
  derived and/or modified sequence opt1 from hemagglutinin__InfluenzaA__ACX31960

SEQ ID NO: 64458 - RNA, 1701 nt, Artificial Sequence
  derived and/or modified sequence opt1 from hemagglutinin__InfluenzaA__ACX31961
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuucauggacaucuggacguacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgugaagcuggaguccacccgcaucuaccagauccuggcgaucuacagcaccgucgccagcucccucgugcugguggucagccugggggccaucuccuucuggaugugcagcaacggcucccuccagugccggaucugcaucuga

SEQ ID NO: 64459 - RNA, 1701 nt, Artificial Sequence; identical to SEQ ID NO: 63677
  derived and/or modified sequence opt1 from hemagglutinin__InfluenzaA__ACX31962

SEQ ID NO: 64460 - RNA, 1701 nt, Artificial Sequence; identical to SEQ ID NO: 63677
  derived and/or modified sequence opt1 from hemagglutinin__InfluenzaA__ACX31964

SEQ ID NO: 64461 - RNA, 1701 nt, Artificial Sequence; identical to SEQ ID NO: 63664
  derived and/or modified sequence opt1 from hemagglutinin__InfluenzaA__ACX35237

SEQ ID NO: 64462 - RNA, 1701 nt, Artificial Sequence; identical to SEQ ID NO: 63677
  derived and/or modified sequence opt1 from hemagglutinin__InfluenzaA__ACX35247

SEQ ID NO: 64463 - RNA, 1701 nt, Artificial Sequence; identical to SEQ ID NO: 63677
  derived and/or modified sequence opt1 from hemagglutinin__InfluenzaA__ACX35257

SEQ ID NO: 64464 - RNA, 1701 nt, Artificial Sequence; identical to SEQ ID NO: 63677
  derived and/or modified sequence opt1 from hemagglutinin__InfluenzaA__ACX35267

SEQ ID NO: 64465 - RNA, 1701 nt, Artificial Sequence; identical to SEQ ID NO: 63677
  derived and/or modified sequence opt1 from hemagglutinin__InfluenzaA__ACX35277

SEQ ID NO: 64466 - RNA, 1701 nt, Artificial Sequence; identical to SEQ ID NO: 63677
  derived and/or modified sequence opt1 from hemagglutinin__InfluenzaA__ACX35287

SEQ ID NO: 64467 - RNA, 1701 nt, Artificial Sequence; identical to SEQ ID NO: 63677
  derived and/or modified sequence opt1 from hemagglutinin__InfluenzaA__ACX35297

SEQ ID NO: 64468 - RNA, 1701 nt, Artificial Sequence
  derived and/or modified sequence opt1 from hemagglutinin__InfluenzaA__ACX35307
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggggcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 64469 - RNA, 1701 nt, Artificial Sequence; identical to SEQ ID NO: 63919
  derived and/or modified sequence opt1 from hemagglutinin__InfluenzaA__ACX35317

SEQ ID NO: 64470 - RNA, 1701 nt, Artificial Sequence
  derived and/or modified sequence opt1 from hemagglutinin__InfluenzaA__ACX35327
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacuccuacguguucgugggcacgagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgccaccggccugcgcaacgucccgagcauccagucccgggggcuguucggcgcgaucgccggguucaucgagggcggcuggacggggaugguggacggcugguacggguaccaccaccagaacgagcagggcagcggguacgccgccgaccucaaguccacccagaacgccaucgacgagaucaccaacaaggugaacagcgucaucgagaagaugaacacccaguucacggcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 64471 - RNA, 1701 nt, Artificial Sequence
  derived and/or modified sequence opt1 from hemagglutinin__InfluenzaA__ACX36501
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagcaucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccuggacaucuggaccuacaacgccgagcuccuggugcugcucgagaacgagcggacccuggacuaccacgacagcaacgugaagaaccuguacgagaagguccgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcuggagagcacccgcaucuaccagauccucgcgaucuacuccaccgucgccagcagccuggugcugguggucucccucggggccaucagcuucuggaugugcuccaacggcagccugcagugccggaucugcaucuga

SEQ ID NO: 64472 - RNA, 1701 nt, Artificial Sequence
  derived and/or modified sequence opt1 from hemagglutinin__InfluenzaA__ACX36502
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagcaucuaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcuggagagcacccgcaucuaccagauccucgcgaucuacuccaccguggccagcagccugguccugguggugucccucggggccaucagcuucuggaugugcuccaacggcagccugcagugccggaucugcaucuga

SEQ ID NO: 64473 - RNA, 1701 nt, Artificial Sequence
  derived and/or modified sequence opt1 from hemagglutinin__InfluenzaA__ACX36503
augaaggccauccuggugguccuccuguacaccuucgccaccgcgaacgccgacacgcugugcaucggcuaccacgccaacaacagcaccgacaccguggacaccauccucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagcaucuaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccugguggugccccgguacgccuucgccauggagcgcaacgccggguccggcaucaucaucagcgacacgcccguccacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccugguccugcucgagaacgagcggacccuggacuaccacgacagcaacgugaagaaccuguacgagaaggugcgcucccagcucaagaacaacaccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcuggagagcacccgcaucuaccagauccucgccaucuacuccaccguggcgagcagccugguccugguggugucccucggggccaucagcuucuggaugugcuccaacggcagccugcagugccggaucugcaucuga

SEQ ID NO: 64474 - RNA, 1701 nt, Artificial Sequence
  derived and/or modified sequence opt1 from hemagglutinin__InfluenzaA__ACX47367
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccuggugaagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 64475 - RNA, 1701 nt, Artificial Sequence
  derived and/or modified sequence opt1 from hemagglutinin__InfluenzaA__ACX47368
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 64476 - RNA, 1701 nt, Artificial Sequence; identical to SEQ ID NO: 64475
  derived and/or modified sequence opt1 from hemagglutinin__InfluenzaA__ACX47369

SEQ ID NO: 64477 - RNA, 1701 nt, Artificial Sequence
  derived and/or modified sequence opt1 from hemagglutinin__InfluenzaA__ACX47370
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccggcagucccuguaccagaacgccgacgccuacguguucgugggcacgagccgcuacuccaagaaguucaagccggagaucgccauccggcccaagguccgcgaccaggagggccggaugaacuacuacuggacccugguggagcccggggacaagaucaccuucgaggcgaccggcaaccucguggucccccgcuacgccuucgccauggagcggaacgccgggagcggcaucaucaucuccgacacgccggugcacgacugcaacacgaccugccagacccccaagggcgccaucaacaccagccugcccuuccagaacauccaccccaucaccaucgggaagugcccgaaguacgugaaguccaccaagcugcgccucgcgaccggccugcggaacguccccagcauccagucccgcgggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccuccagccuggugcucguggucagccugggggccaucuccuucuggaugugcagcaacggcucccugcagugccgcaucugcaucuga

SEQ ID NO: 64478 - RNA, 1701 nt, Artificial Sequence; identical to SEQ ID NO: 64475
  derived and/or modified sequence opt1 from hemagglutinin__InfluenzaA__ACX47371

SEQ ID NO: 64479 - RNA, 1701 nt, Artificial Sequence; identical to SEQ ID NO: 64475
  derived and/or modified sequence opt1 from hemagglutinin__InfluenzaA__ACX47372

SEQ ID NO: 64480 - RNA, 1701 nt, Artificial Sequence; identical to SEQ ID NO: 64475
  derived and/or modified sequence opt1 from hemagglutinin__InfluenzaA__ACX47373

SEQ ID NO: 64481 - RNA, 1701 nt, Artificial Sequence; identical to SEQ ID NO: 64475
  derived and/or modified sequence opt1 from hemagglutinin__InfluenzaA__ACX47374

SEQ ID NO: 64482 - RNA, 1701 nt, Artificial Sequence
  derived and/or modified sequence opt1 from hemagglutinin__InfluenzaA__ACX47375
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacccgaacaagggggucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagccggagaucgccauccgccccaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgccggugcacgacugcaacacgaccugccagacccccaacggcgccaucaacaccagccugcccuuccagaacauccaccccaucaccaucgggaagugcccgaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccuccagccuggugcucguggucagccugggggccaucuccuucuggaugugcagcaacggcucccugcagugccggaucugcaucuga

SEQ ID NO: 64483 - RNA, 1701 nt, Artificial Sequence; identical to SEQ ID NO: 64475
  derived and/or modified sequence opt1 from hemagglutinin__InfluenzaA__ACX47376

SEQ ID NO: 64484 - RNA, 1701 nt, Artificial Sequence; identical to SEQ ID NO: 64475
  derived and/or modified sequence opt1 from hemagglutinin__InfluenzaA__ACX47377

SEQ ID NO: 64485 - RNA, 1701 nt, Artificial Sequence
  derived and/or modified sequence opt1 from hemagglutinin__InfluenzaA__ACX47380
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccaccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgugauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucaccaacaaggucaacuccgugaucgagaagaugaacacgcaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggccagcagccuggugcucgucgugucccugggggcgaucagcuucuggaugugcuccaacggcagccugcagugccggaucugcaucuga

SEQ ID NO: 64486 - RNA, 1701 nt, Artificial Sequence; identical to SEQ ID NO: 64485
  derived and/or modified sequence opt1 from hemagglutinin__InfluenzaA__ACX47381

SEQ ID NO: 64487 - RNA, 1701 nt, Artificial Sequence; identical to SEQ ID NO: 64485
  derived and/or modified sequence opt1 from hemagglutinin__InfluenzaA__ACX47382

SEQ ID NO: 64488 - RNA, 1701 nt, Artificial Sequence
  derived and/or modified sequence opt1 from hemagglutinin__InfluenzaA__ACX47383
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccaccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggagaagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 64489 - RNA, 1701 nt, Artificial Sequence
  derived and/or modified sequence opt1 from hemagglutinin__InfluenzaA__ACX47384
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccaccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcaccucccgguacagcaagaaguucaagcccgagaucgccauccgcccgaagguccgggaccaggagggccgcaugaacuacuacuggacccugguggagcccggggacaagaucaccuucgaggccacgggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacuccaccgucgcgagcagccuggugcucguggucucccugggggccaucagcuucuggaugugcuccaacggcagccugcagugccggaucugcaucuga

SEQ ID NO: 64490 - RNA, 1701 nt, Artificial Sequence; identical to SEQ ID NO: 64489
  derived and/or modified sequence opt1 from hemagglutinin__InfluenzaA__ACX47385

SEQ ID NO: 64491 - RNA, 1701 nt, Artificial Sequence; identical to SEQ ID NO: 64489
  derived and/or modified sequence opt1 from hemagglutinin__InfluenzaA__ACX47387

SEQ ID NO: 64492 - RNA, 1701 nt, Artificial Sequence; identical to SEQ ID NO: 63677
  derived and/or modified sequence opt1 from hemagglutinin__InfluenzaA__ACX55834

SEQ ID NO: 64493 - RNA, 1701 nt, Artificial Sequence; identical to SEQ ID NO: 64475
  derived and/or modified sequence opt1 from hemagglutinin__InfluenzaA__ACX61574

SEQ ID NO: 64494 - RNA, 1701 nt, Artificial Sequence; identical to SEQ ID NO: 63677
  derived and/or modified sequence opt1 from hemagglutinin__InfluenzaA__ACX61575

SEQ ID NO: 64495 - RNA, 1701 nt, Artificial Sequence
  derived and/or modified sequence opt1 from hemagglutinin__InfluenzaA__ACX83577
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagcuucuccaccagcuccagcugguccuacaucguggagaccagcuccagcgacaacggcacgugcuaccccggcgacuucaucgacuacgaggagcugcgggagcagcucuccagcguguccagcuucgagcgcuucgagaucuuccccaagaccuccagcuggcccaaccacgacuccaacaagggggucaccgccgccugcccgcacgccggcgccaagagcuucuacaagaaccugaucuggcuggugaagaaggggaacuccuaccccaagcucagcaagagcuacaucaacgacaagggcaaggaggugcugguccugugggggauccaccaccccuccaccagcgcggaccagcagucccucuaccagaacgccgacgccuacguguucgugggcacgagccgguacuccaagaaguucaagcccgagaucgccauccgcccgaagguccggggccaggaggggcgcaugaacuacuacuggacccugguggagcccggcgacaagaucaccuucgaggccaccgggaaccugguggucccccgguacgcguucgccauggagcgcaacgccggcagcggcaucaucaucuccgacacgcccgugcacgacugcaacacgaccugccagaccccgaagggggccaucaacaccagccuccccuuccagaacauccaccccaucaccaucggcaagugccccaaguacgugaaguccaccaagcugcggcuggccaccgggcuccgcaacgucccgagcauccagucccggggccuguucggggcgaucgccggcuucaucgagggcggguggacgggcaugguggacgggugguacggcuaccaccaccagaacgagcaggggagcggcuacgccgccgaccugaaguccacccagaacgccaucgacgagaucaccaacaaggugaacagcgucaucgagaagaugaacacccaguucacggcggugggcaaggaguucaaccaccucgagaagcgcaucgagaaccugaacaagaaggucgacgacggguuccuggacaucuggaccuacaacgccgagcuccuggugcugcucgagaacgagcggacccuggacuaccacgacuccaacgugaagaaccuguacgagaagguccgcagccagcucaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcuggaguccacccgcaucuaccagauccucgccaucuacagcaccgucgcgagcucccuggugcugguggucagccucggcgccaucuccuucuggaugugcagcaacggcucccugcagugccggaucugcaucuga

SEQ ID NO: 64496 - RNA, 1701 nt, Artificial Sequence
  derived and/or modified sequence opt1 from hemagglutinin__InfluenzaA__ACX94091
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccaucagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcacgagccgguacuccaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugcuccaaguacgucaagagcaccaagcugcggcucgcgaccggccugcgcaacgugcccuccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64497 - RNA, 1701 nt, Artificial Sequence
  derived and/or modified sequence opt1 from hemagglutinin__InfluenzaA__ACY26192
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacaacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccaggacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64498 - RNA, 1701 nt, Artificial Sequence; identical to SEQ ID NO: 64246
  derived and/or modified sequence opt1 from hemagglutinin__InfluenzaA__ACY26202

SEQ ID NO: 64499 - RNA, 1701 nt, Artificial Sequence; identical to SEQ ID NO: 63677
  derived and/or modified sequence opt1 from hemagglutinin__InfluenzaA__ACY46103

SEQ ID NO: 64500 - RNA, 1701 nt, Artificial Sequence; identical to SEQ ID NO: 63677
  derived and/or modified sequence opt1 from hemagglutinin__InfluenzaA__ACY46113

SEQ ID NO: 64501 - RNA, 1701 nt, Artificial Sequence
  derived and/or modified sequence opt1 from hemagglutinin__InfluenzaA__ACY46123
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaaggucggcgaccaggaggggcggaugaacuacuacuggacccugguggagcccggcgacaagaucaccuucgaggcgaccgggaaccucguggucccccgcuacgccuucgccauggagcggaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcgccucgcgaccgggcugcggaacgugccguccauccagagccgcggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggguuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacggcagccugcagugccgcaucugcaucuga

SEQ ID NO: 64502 - RNA, 1701 nt, Artificial Sequence; identical to SEQ ID NO: 63677
  derived and/or modified sequence opt1 from hemagglutinin__InfluenzaA__ACY46133

SEQ ID NO: 64503 - RNA, 1701 nt, Artificial Sequence; identical to SEQ ID NO: 63677
  derived and/or modified sequence opt1 from hemagglutinin__InfluenzaA__ACY46163

SEQ ID NO: 64504 - RNA, 1701 nt, Artificial Sequence
  derived and/or modified sequence opt1 from hemagglutinin__InfluenzaA__ACY46173
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 64505 - RNA, 1701 nt, Artificial Sequence; identical to SEQ ID NO: 63677
  derived and/or modified sequence opt1 from hemagglutinin__InfluenzaA__ACY46213

SEQ ID NO: 64506 - RNA, 1701 nt, Artificial Sequence; identical to SEQ ID NO: 63677
  derived and/or modified sequence opt1 from hemagglutinin__InfluenzaA__ACY46223

SEQ ID NO: 64507 - RNA, 1701 nt, Artificial Sequence; identical to SEQ ID NO: 63677
  derived and/or modified sequence opt1 from hemagglutinin__InfluenzaA__ACY46233

SEQ ID NO: 64508 - RNA, 1701 nt, Artificial Sequence; identical to SEQ ID NO: 63677
  derived and/or modified sequence opt1 from hemagglutinin__InfluenzaA__ACY46243

SEQ ID NO: 64509 - RNA, 1701 nt, Artificial Sequence; identical to SEQ ID NO: 63677
  derived and/or modified sequence opt1 from hemagglutinin__InfluenzaA__ACY46253

SEQ ID NO: 64510 - RNA, 1701 nt, Artificial Sequence; identical to SEQ ID NO: 63677
  derived and/or modified sequence opt1 from hemagglutinin__InfluenzaA__ACY46263

SEQ ID NO: 64511 - RNA, 1701 nt, Artificial Sequence; identical to SEQ ID NO: 63677
  derived and/or modified sequence opt1 from hemagglutinin__InfluenzaA__ACY46273

SEQ ID NO: 64512 - RNA, 1701 nt, Artificial Sequence; identical to SEQ ID NO: 63677
  derived and/or modified sequence opt1 from hemagglutinin__InfluenzaA__ACY46283

SEQ ID NO: 64513 - RNA, 1701 nt, Artificial Sequence
  derived and/or modified sequence opt1 from hemagglutinin__InfluenzaA__ACY46293
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcggccggccugcgcaacgugccguccauccagagccgggggcuguucggcgccaucgccggguucaucgagggcggcuggaccgggaugguggacggcugguacggguaccaccaccagaacgagcagggcuccggguacgccgcggaccucaagagcacgcagaacgccaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 64514 - RNA, 1701 nt, Artificial Sequence; identical to SEQ ID NO: 63677
  derived and/or modified sequence opt1 from hemagglutinin__InfluenzaA__ACY46303

SEQ ID NO: 64515 - RNA, 1701 nt, Artificial Sequence; identical to SEQ ID NO: 63677
  derived and/or modified sequence opt1 from hemagglutinin__InfluenzaA__ACY46313

SEQ ID NO: 64516 - RNA, 1701 nt, Artificial Sequence; identical to SEQ ID NO: 63677
  derived and/or modified sequence opt1 from hemagglutinin__InfluenzaA__ACY46323

SEQ ID NO: 64517 - RNA, 1701 nt, Artificial Sequence; identical to SEQ ID NO: 63677
  derived and/or modified sequence opt1 from hemagglutinin__InfluenzaA__ACY46343

SEQ ID NO: 64518 - RNA, 1701 nt, Artificial Sequence; identical to SEQ ID NO: 63677
  derived and/or modified sequence opt1 from hemagglutinin__InfluenzaA__ACY46353

SEQ ID NO: 64519 - RNA, 1701 nt, Artificial Sequence
  derived and/or modified sequence opt1 from hemagglutinin__InfluenzaA__ACY46373
augaaggccauccugaucgugcuccuguacaccuucgccaccgcgaacgccgacacgcugugcaucggcuaccacgccaacaacagcaccgacaccgucgacaccgugcucgagaagaacgugacggucacccacuccgugaaccugcuggaggacaagcacaacgggaagcucugcaagcugcgcggcguggcgccccugcaccucgggaagugcaacaucgccggcuggauccuggggaacccggagugcgagagccuguccaccgccagcuccuggagcuacaucgucgagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggugaccgccgccugcccgcacgccggcgcgaaguccuucuacaagaaccugaucuggcucgucaagaaggggaacagcuaccccaagcuguccaagagcuacaucaacgacaagggcaaggaggugcuggugcucugggggauccaccaccccagcaccuccgccgaccagcagagccuguaccagaacgccgacgccuacgucuucgugggcacgucccgguacagcaagaaguucaagcccgagaucgccauccgcccgaaggugcgggaccaggagggccgcaugaacuacuacuggacccuggucgagcccggggacaagaucaccuucgaggcgaccggcaaccucguggugccccgguacgccuucgccauggagcgcaacgccggguccggcaucaucaucagcgacacgcccguccacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 64520 - RNA, 1701 nt, Artificial Sequence
  derived and/or modified sequence opt1 from hemagglutinin__InfluenzaA__ACY46383
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64521 - RNA, 1701 nt, Artificial Sequence; identical to SEQ ID NO: 63677
  derived and/or modified sequence opt1 from hemagglutinin__InfluenzaA__ACY46393

SEQ ID NO: 64522 - RNA, 1701 nt, Artificial Sequence; identical to SEQ ID NO: 63677
  derived and/or modified sequence opt1 from hemagglutinin__InfluenzaA__ACY46403

SEQ ID NO: 64523 - RNA, 1701 nt, Artificial Sequence; identical to SEQ ID NO: 63677
  derived and/or modified sequence opt1 from hemagglutinin__InfluenzaA__ACY46413

SEQ ID NO: 64524 - RNA, 1701 nt, Artificial Sequence; identical to SEQ ID NO: 63677
  derived and/or modified sequence opt1 from hemagglutinin__InfluenzaA__ACY46433

SEQ ID NO: 64525 - RNA, 1701 nt, Artificial Sequence; identical to SEQ ID NO: 63677
  derived and/or modified sequence opt1 from hemagglutinin__InfluenzaA__ACY46443

SEQ ID NO: 64526 - RNA, 1701 nt, Artificial Sequence; identical to SEQ ID NO: 63677
  derived and/or modified sequence opt1 from hemagglutinin__InfluenzaA__ACY46453

SEQ ID NO: 64527 - RNA, 1701 nt, Artificial Sequence
  derived and/or modified sequence opt1 from hemagglutinin__InfluenzaA__ACY46463
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggugcgcaacgccggguccggcaucaucaucagcgacacgcccgugcacgacugcaacacgaccugccagaccccgaagggcgccaucaacaccucccuccccuuccagaacauccaccccaucaccaucgggaagugccccaaguacgucaagagcaccaagcugcggcuggcgaccggccuccgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccuggacaucuggaccuacaacgccgagcuccuggugcugcucgagaacgagcggacccuggacuaccacgacagcaacgucaagaaccuguacgagaaggugcgcucccagcucaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcuggagagcacccgcaucuaccagauccucgcgaucuacuccaccguggccagcagccuggugcuggucgugucccucggggccaucagcuucuggaugugcuccaacggcagccugcagugccggaucugcaucuga

SEQ ID NO: 64528 - RNA, 1701 nt, Artificial Sequence; identical to SEQ ID NO: 63677
  derived and/or modified sequence opt1 from hemagglutinin__InfluenzaA__ACY46473

SEQ ID NO: 64529 - RNA, 1701 nt, Artificial Sequence; identical to SEQ ID NO: 63664
  derived and/or modified sequence opt1 from hemagglutinin__InfluenzaA__ACY46493

SEQ ID NO: 64530 - RNA, 1701 nt, Artificial Sequence
  derived and/or modified sequence opt1 from hemagglutinin__InfluenzaA__ACY46513
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggacaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 64531 - RNA, 1701 nt, Artificial Sequence; identical to SEQ ID NO: 63677
  derived and/or modified sequence opt1 from hemagglutinin__InfluenzaA__ACY46523

SEQ ID NO: 64532 - RNA, 1701 nt, Artificial Sequence; identical to SEQ ID NO: 63677
  derived and/or modified sequence opt1 from hemagglutinin__InfluenzaA__ACY46533

SEQ ID NO: 64533 - RNA, 1701 nt, Artificial Sequence; identical to SEQ ID NO: 63677
  derived and/or modified sequence opt1 from hemagglutinin__InfluenzaA__ACY46562

SEQ ID NO: 64534 - RNA, 1701 nt, Artificial Sequence; identical to SEQ ID NO: 63677
  derived and/or modified sequence opt1 from hemagglutinin__InfluenzaA__ACY46572

SEQ ID NO: 64535 - RNA, 1701 nt, Artificial Sequence; identical to SEQ ID NO: 63677
  derived and/or modified sequence opt1 from hemagglutinin__InfluenzaA__ACY46582

SEQ ID NO: 64536 - RNA, 1701 nt, Artificial Sequence; identical to SEQ ID NO: 63677
  derived and/or modified sequence opt1 from hemagglutinin__InfluenzaA__ACY46592

SEQ ID NO: 64537 - RNA, 1701 nt, Artificial Sequence; identical to SEQ ID NO: 63677
  derived and/or modified sequence opt1 from hemagglutinin__InfluenzaA__ACY46622

SEQ ID NO: 64538 - RNA, 1701 nt, Artificial Sequence
  derived and/or modified sequence opt1 from hemagglutinin__InfluenzaA__ACY46672
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggugcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggucaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggcgaucuacuccaccguggccagcagccuggugcucgucgugucccugggggccaucagcuucuggaugugcuccaacggcagccugcagugccggaucugcaucuga

SEQ ID NO: 64539 - RNA, 1701 nt, Artificial Sequence; identical to SEQ ID NO: 63677
  derived and/or modified sequence opt1 from hemagglutinin__InfluenzaA__ACY46682

SEQ ID NO: 64540 - RNA, 1701 nt, Artificial Sequence; identical to SEQ ID NO: 63677
  derived and/or modified sequence opt1 from hemagglutinin__InfluenzaA__ACY46692

SEQ ID NO: 64541 - RNA, 1701 nt, Artificial Sequence; identical to SEQ ID NO: 63677
  derived and/or modified sequence opt1 from hemagglutinin__InfluenzaA__ACY46712

SEQ ID NO: 64542 - RNA, 1701 nt, Artificial Sequence
  derived and/or modified sequence opt1 from hemagglutinin__InfluenzaA__ACY46722
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccggccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 64543 - RNA, 1701 nt, Artificial Sequence
  derived and/or modified sequence opt1 from hemagglutinin__InfluenzaA__ACY46742
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcaacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64544 - RNA, 1701 nt, Artificial Sequence; identical to SEQ ID NO: 63677
  derived and/or modified sequence opt1 from hemagglutinin__InfluenzaA__ACY46762

SEQ ID NO: 64545 - RNA, 1701 nt, Artificial Sequence; identical to SEQ ID NO: 63677
  derived and/or modified sequence opt1 from hemagglutinin__InfluenzaA__ACY46772

SEQ ID NO: 64546 - RNA, 1701 nt, Artificial Sequence; identical to SEQ ID NO: 63677
  derived and/or modified sequence opt1 from hemagglutinin__InfluenzaA__ACY46903

SEQ ID NO: 64547 - RNA, 1701 nt, Artificial Sequence; identical to SEQ ID NO: 63703
  derived and/or modified sequence opt1 from hemagglutinin__InfluenzaA__ACY77534

SEQ ID NO: 64548 - RNA, 1698 nt, Artificial Sequence
  derived and/or modified sequence opt1 from hemagglutinin__InfluenzaA__ACY77544
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacaccacggugcacgacugcaacacgaccugccagacccccaagggcgccaucaacaccagccucccguuccagaacauccaccccaucaccaucgggaagugccccaaguacgugaaguccaccaagcugcggcuggcgaccggccuccgcaacguccccagcauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcuggucccugcagugccggaucugcaucuga

SEQ ID NO: 64549 - RNA, 1698 nt, Artificial Sequence
  derived and/or modified sequence opt1 from hemagglutinin__InfluenzaA__ACY77554
augaaggccauccuggugguccugcuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacaacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccggccaccuccagugccggaucugcaucuga

SEQ ID NO: 64550 - RNA, 1695 nt, Artificial Sequence
  derived and/or modified sequence opt1 from hemagglutinin__InfluenzaA__ACY77573
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagagcgcgaucgacgagaucaccaacaaggugaacuccgucaucgagaagaugaacacccagcugaccggccagugcaaggaguucaaccaccuggagaagcgcaucgagaaccucaacaagaagguggacgacggcuuccuggacaucuggacguacaacgccgagcugcucguccugcuggagaacgagcggacccucgacuaccacgacagcaacgugaagaaccuguacgagaaggugcgcucccagcugaagaacaacgccaacgagaucgggaacggcugcuucgaguucuaccacaagugcgacaacacgugcauggagagcgucaagaacgggaccuacgacuaccccaaguacuccgaggaggccaagcucaaccgggaggagaucgacggcgugaagcuggagagcacccgcaucuaccagauccuggccaucuacagcaccguggcguccagccucguccugguggugucccugggggccaucagcuucuggaugugcuccggccacagcugccggaucugcaucuga

SEQ ID NO: 64551 - RNA, 1701 nt, Artificial Sequence
  derived and/or modified sequence opt1 from hemagglutinin__InfluenzaA__ACY77593
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacaccacggugcacgacugcaacacgaccugccagacccccaagggcgccaucaacaccagccucccguuccagaacauccaccccaucaccaucgggaagugccccaaguacgugaaguccaccaagcugcggcuggcgaccggccuccgcaacguccccagcauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcaacggcucccugcagugccggaucugcaucuga

SEQ ID NO: 64552 - RNA, 1698 nt, Artificial Sequence
  derived and/or modified sequence opt1 from hemagglutinin__InfluenzaA__ACY77603
augaaggccauccugguggucaugcucuacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcuggucccugcagugccggaucugcaucuga

SEQ ID NO: 64553 - RNA, 1695 nt, Artificial Sequence
  derived and/or modified sequence opt1 from hemagglutinin__InfluenzaA__ACY77613
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacgggccagugcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccggccacagcugccggaucugcaucuga

SEQ ID NO: 64554 - RNA, 1701 nt, Artificial Sequence; identical to SEQ ID NO: 63677
  derived and/or modified sequence opt1 from hemagglutinin__InfluenzaA__ACY77623

SEQ ID NO: 64555 - RNA, 1707 nt, Artificial Sequence
  derived and/or modified sequence opt1 from hemagglutinin__InfluenzaA__ACY77653
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacagcaccguggccagcucccuggugcuggucgugagccucggggccaucuccuucuggaugugcagcggccacuccggcagccugcagugccggaucugcaucuga

SEQ ID NO: 64556 - RNA, 1698 nt, Artificial Sequence
  derived and/or modified sequence opt1 from hemagglutinin__InfluenzaA__ACY77663
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccuggagccugcucugccggaucugcaucuga

SEQ ID NO: 64557 - RNA, 1698 nt, Artificial Sequence
  derived and/or modified sequence opt1 from hemagglutinin__InfluenzaA__ACY77683
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccgccgugggcaaggaguucaaccaccucgagaagcgcaucgagaaccugaacaagaaggucgacgacggcuuccuggacaucuggacguacaacgccgagcuccuggugcugcucgagaacgagcggacccuggacuaccacgacuccaacgugaagaaccuguacgagaagguccgcagccagcucaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcuggaguccacccgcaucuaccagauccucgcgaucuacagcaccguggccagcucccuggugcuggucgugagccucggggccaucuccuucuggaugugcagcuggucccugcagugccggaucugcaucuga

SEQ ID NO: 64558 - RNA, 1698 nt, Artificial Sequence
  derived and/or modified sequence opt1 from hemagglutinin__InfluenzaA__ACY77693
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucacgauccgcccgaagguccgggaccaggagggccgcaugaacuacuacuggacccugguggagcccggggacaagaucaccuucgaggccaccggcaaccugguggucccccgguacgcguucgccauggagcgcaacgccgggagcggcaucaucaucuccgacacgcccgugcacgacugcaacacgaccugccagaccccgaagggcgccaucaacaccagccuccccuuccagaacauccaccccaucaccaucgggaagugccccaaguacgugaaguccaccaagcugcggcuggccaccggccuccgcaacgucccgagcauccagucccgggggcuguucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacagcgucaucgagaagaugaacacccaguucacgggccagugcaaggaguucaaccaccucgagaagcgcaucgagaaccugaacaagaagguggacgacggcuuccuggacaucuggaccuacaacgcggagcuccugguccugcucgagaacgagcggacccuggacuaccacgacuccaacgugaagaaccuguacgagaaggugcgcagccagcucaagaacaacgccaaggaggucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacagcaccgucgccagcucccuggugcugguggucagccucggggcgaucuccuucuggaugugcagcuggucccugcagugccggaucugcaucuga

SEQ ID NO: 64559 - RNA, 1698 nt, Artificial Sequence
  derived and/or modified sequence opt1 from hemagglutinin__InfluenzaA__ACY77703
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccggccagugcaaggaguucaaccaccucgagaagcgcaucgagaaccugaacaagaagguggacgacggcuuccuggacaucuggacguacaacgccgagcuccugguccugcucgagaacgagcggacccuggacuaccacgacuccaacgugaagaaccuguacgagaaggugcgcagccagcucaagaacaacgccaaggaggucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacagcaccgucgcgagcucccuggugcugguggucagccucggggccaucuccuucuggaugugcagcuggucccugcagugccggaucugcaucuga

SEQ ID NO: 64560 - RNA, 1698 nt, Artificial Sequence
  derived and/or modified sequence opt1 from hemagglutinin__InfluenzaA__ACY77713
augaaggccauccuggugguccugcuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggugaacagcgucaucgagaagaugaacacccaguucaccggccagugcaaggaguucaaccaccucgagaagcgcaucgagaaccugaacaagaagguggacgacggcuuccuggacaucuggacguacaacgccgagcuccugguccugcucgagaacgagcggacccuggacuaccacgacuccaacgugaagaaccuguacgagaaggugcgcagccagcucaagaacaacgccaaggaggucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgccaucuacagcaccgucgcgagcucccuggugcugguggucagccucggggccaucuccuucuggaugugcagcggccaccuccagugccggaucugcaucuga

SEQ ID NO: 64561 - RNA, 1701 nt, Artificial Sequence; identical to SEQ ID NO: 63990
  derived and/or modified sequence opt1 from hemagglutinin__InfluenzaA__ACY77723

SEQ ID NO: 64562 - RNA, 1695 nt, Artificial Sequence
  derived and/or modified sequence opt1 from hemagglutinin__InfluenzaA__ACY77733
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaccgggaacagcuaccccaagcucuccaagagcuacaucaacgacaagggcaaggaggugcugguccugugggggauccaccaccccagcacguccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggcgaccggcaaccugguggucccccgguacgccuucgccauggagcgcaacgccgggagcggcaucaucaucuccgacacgcccgugcacgacugcaacacgaccugccagaccccgaagggcgccaucaacaccagccuccccuuccagaacauccaccccaucaccaucgggaagugccccaaguacgugaaguccaccaagcugcggcuggcgaccggccuccgcaacgucccgagcauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcggccugcagugccggaucugcaucuga

SEQ ID NO: 64563 - RNA, 1698 nt, Artificial Sequence
  derived and/or modified sequence opt1 from hemagglutinin__InfluenzaA__ACY77743
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagguggggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccagcucccuggugcucgucgugagccugggggccaucuccuucuggaugugcagcuggucccugcagugccggaucugcaucuga

SEQ ID NO: 64564 - RNA, 1701 nt, Artificial Sequence; identical to SEQ ID NO: 63677
  derived and/or modified sequence opt1 from hemagglutinin__InfluenzaA__ACY77753

SEQ ID NO: 64565 - RNA, 1695 nt, Artificial Sequence
  derived and/or modified sequence opt1 from hemagglutinin__InfluenzaA__ACY77783
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcugggggacaagcacaacggcaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacggcacgugcuaccccggggacuucaucgacuacgaggagcuccgggagcagcugagcuccgugagcuccuucgagcgcuucgagaucuuccccaagaccagcuccuggcccaaccacgacagcgacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacacguacguguucgugggcaccucccgguacagcaagaaguucaagcccgagaucgccauccgcccgaagguccgggaccaggaggggcgcaugaacuacuacuggacccugguggagcccggcgacaagaucaccuucgaggccacggggaaccucguggucccccgguacgcguucgccauggagcgcaacgccggcuccggcaucaucaucagcgacacccccgugcacgacugcaacacgaccugccagaccccgaagggggccaucaacaccucccugcccuuccagaacauccaccccaucaccaucggcaagugccccaaguacgucaagagcaccaagcugcggcucgccacggggcugcgcaacgugccguccauccagagccggggccuguucggggcgaucgccggcuucaucgagggcggguggaccggcaugguggacgggugguacggcuaccaccaccagaacgagcagggguccggcuacgccgccgaccucaagagcacccagaacgccaucgacgagaucaccaacaaggugaacuccgucaucgagaagaugaacacgcaguucaccgcggugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagucccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggccaucuacagcaccgucgcgagcucccuggugcucguggucagccugggcgccaucuccuucuggaugugcagcggccacuccugccggaucugcaucuga

SEQ ID NO: 64566 - RNA, 1698 nt, Artificial Sequence
  derived and/or modified sequence opt1 from hemagglutinin__InfluenzaA__ACY77813
augaaggccauccuggugguccugcuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacgggccagugcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccggccaccuccagugccggaucugcaucuga

SEQ ID NO: 64567 - RNA, 1698 nt, Artificial Sequence
  derived and/or modified sequence opt1 from hemagglutinin__InfluenzaA__ACY77823
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacgggccagugcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggccaucuacuccaccguggcgagcagccugguccucguggugucccugggggccaucagcuucuggaugugcuccuggagccugcagugccggaucugcaucuga

SEQ ID NO: 64568 - RNA, 1698 nt, Artificial Sequence
  derived and/or modified sequence opt1 from hemagglutinin__InfluenzaA__ACY77833
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccuggagccugcagugccggaucugcaucuga

SEQ ID NO: 64569 - RNA, 1698 nt, Artificial Sequence
  derived and/or modified sequence opt1 from hemagglutinin__InfluenzaA__ACY77843
augaaggccauccugguggucaugcuguacaccuucgccaccgcgaacgccgacacgcugugcaucggcuaccacgccaacaacagcaccgacaccguggacaccgugcuggagaagaacgucacggugacccacuccgugaaccuccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacaccacggugcacgacugcaacacgaccugccagacccccaagggcgccaucaacaccagccucccguuccagaacauccaccccaucaccaucgggaagugccccaaguacgugaaguccaccaagcugcggcuggcgaccggccuccgcaacguccccagcauccagucccgggggcuguucggcgccaucgccggguucaucgagggcggcuggacggggaugguggacggcugguacggguaccaccaccagaacgagcagggcagcggguacgccgccgaccugaaguccacccagaacgcgaucgacgagaucaccaacaaggugaacagcgucaucgagaagaugaacacccaguucacggccgugggcaaggaguucaaccaccucgagaagcgcaucgagaaccugaacaagaaggucgacgacggcuuccuggacaucuggaccuacaacgccgagcuccuggugcugcucgagaacgagcggacccuggacuaccacgacuccaacgugaagaaccuguacgagaagguccgcagccagcucaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcuggaguccacccgcaucuaccagauccucgcgaucuacagcaccgucgccagcucccuggugcugguggucagccucggggccaucuccuucuggaugugcagcggccaccuccagugccggaucugcaucuga

SEQ ID NO: 64570 - RNA, 1701 nt, Artificial Sequence
  derived and/or modified sequence opt1 from hemagglutinin__InfluenzaA__ACY77863
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccggcaugagccugcagugccggaucugcaucuga

SEQ ID NO: 64571 - RNA, 1701 nt, Artificial Sequence; identical to SEQ ID NO: 63664
  derived and/or modified sequence opt1 from hemagglutinin__InfluenzaA__ACY77874

SEQ ID NO: 64572 - RNA, 1701 nt, Artificial Sequence; identical to SEQ ID NO: 63664
  derived and/or modified sequence opt1 from hemagglutinin__InfluenzaA__ACY77884

SEQ ID NO: 64573 - RNA, 1701 nt, Artificial Sequence
  derived and/or modified sequence opt1 from hemagglutinin__InfluenzaA__ACY77904
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaagcacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 64574 - RNA, 1701 nt, Artificial Sequence; identical to SEQ ID NO: 63857
  derived and/or modified sequence opt1 from hemagglutinin__InfluenzaA__ACY77914

SEQ ID NO: 64575 - RNA, 1701 nt, Artificial Sequence
  derived and/or modified sequence opt1 from hemagglutinin__InfluenzaA__ACY77924
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacgacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64576 - RNA, 1701 nt, Artificial Sequence; identical to SEQ ID NO: 64425
  derived and/or modified sequence opt1 from hemagglutinin__InfluenzaA__ACY77934

SEQ ID NO: 64577 - RNA, 1701 nt, Artificial Sequence
  derived and/or modified sequence opt1 from hemagglutinin__InfluenzaA__ACY77944
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgagagcgggaucaucaucuccgacacccccgugcacgacugcaacacgaccugccagaccccgaagggcgccaucaacaccagccugcccuuccagaacauccaccccaucacgaucggcaagugccccaaguacgugaaguccaccaagcugcggcucgcgaccgggcugcgcaacgucccgagcauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccguggggaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacgggucccugcagugccggaucugcaucuga

SEQ ID NO: 64578 - RNA, 1701 nt, Artificial Sequence; identical to SEQ ID NO: 63664
  derived and/or modified sequence opt1 from hemagglutinin__InfluenzaA__ACY77954

SEQ ID NO: 64579 - RNA, 1701 nt, Artificial Sequence; identical to SEQ ID NO: 63664
  derived and/or modified sequence opt1 from hemagglutinin__InfluenzaA__ACY77964

SEQ ID NO: 64580 - RNA, 1701 nt, Artificial Sequence; identical to SEQ ID NO: 63664
  derived and/or modified sequence opt1 from hemagglutinin__InfluenzaA__ACY77974

SEQ ID NO: 64581 - RNA, 1701 nt, Artificial Sequence; identical to SEQ ID NO: 63664
  derived and/or modified sequence opt1 from hemagglutinin__InfluenzaA__ACY77984

SEQ ID NO: 64582 - RNA, 1701 nt, Artificial Sequence; identical to SEQ ID NO: 63664
  derived and/or modified sequence opt1 from hemagglutinin__InfluenzaA__ACY77994

SEQ ID NO: 64583 - RNA, 1701 nt, Artificial Sequence
  derived and/or modified sequence opt1 from hemagglutinin__InfluenzaA__ACY79633
augaaggagauccuggugguccuccuguacaccuucgccaccgccaacgcggacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgcccgguccgggaucaucaucagcgacacgcccgugcacgacugcaacacgaccugccagaccccgaagggcgccaucaacaccucccugcccuuccagaacauccaccccaucaccaucggcaagugccccaaguacgucaagagcaccaagcugcgccucgccaccgggcugcggaacgugccguccauccagagccgcggccuguucggggcgaucgccggcuucaucgagggcggguggacgggcaugguggacgggugguacggcuaccaccaccagaacgagcagggguccggcuacgccgccgaccucaagagcacccagaacgccaucgacgagaucaccaacaaggugaacuccgucaucgagaagaugaacacccaguucacggcgguggggaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggccaucuacuccaccgucgcgagcagccuggugcucguggucucccugggcgccaucagcuucuggaugugcuccaacgggagccugcagugccgcaucugcaucuga

SEQ ID NO: 64584 - RNA, 1701 nt, Artificial Sequence; identical to SEQ ID NO: 64475
  derived and/or modified sequence opt1 from hemagglutinin__InfluenzaA__ACZ01953

SEQ ID NO: 64585 - RNA, 1701 nt, Artificial Sequence
  derived and/or modified sequence opt1 from hemagglutinin__InfluenzaA__ACZ05050
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcucccacgccggcgccaagagcuucuacaagaaccugaucuggcucgugaagaaggggaacuccuacccgaagcugagcaagagcuacaucaacgacaagggcaaggaggugcugguccucugggggauccaccaccccuccaccagcgccgaccagcagucccuguaccagaacgccgacgccuacguguucgugggcagcucccgguacagcaagaaguucaagcccgagaucgccauccgccccaagguccgggaccaggagggccgcaugaacuacuacuggacgcugguggagccgggggacaagaucaccuucgaggcgaccggcaaccucguggucccccgguacgccuucgccauggagcgcaacgccggguccggcaucaucaucagcgacacccccgugcacgacugcaacacgaccugccagacccccaagggcgccaucaacaccucccugccguuccagaacauccaccccaucacgaucgggaagugccccaaguacgucaagagcaccaagcugcggcucgcgaccggccugcgcaacgugcccuccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuacccgaaguacuccgaggaggccaagcugaaccgggaggagaucgacggcgugaagcucgagagcacccgcaucuaccagauccuggcgaucuacagcaccgucgccuccagccuggugcucguggucucccugggggccaucagcuucuggaugugcuccaacggcagccugcagugccggaucugcaucuga

SEQ ID NO: 64586 - RNA, 1701 nt, Artificial Sequence
  derived and/or modified sequence opt1 from hemagglutinin__InfluenzaA__ACZ05061
auggaggccauccuggugguccuccuguacaccuucaccacggccaacgcggacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgccaaguccuucuacaagaaccugaucuggcucgugaagaaggggaacagcuaccccaagcuguccaagagcuacaucaacgacaagggcaaggaggugcugguccucugggggauccaccaccccagcacguccgcggaccagcagagccuguaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucaccuucgaggccaccggcaaccucguggucccccgguacgcguucgccauggagcgcaacgccgggagcggcaucaucaucuccgacacgcccgugcacgacugcaacacgaccugccagacccugaagggcgccaucaacaccagccugccguuccagaacauccaccccaucaccaucgggaagugccccaaguacgugaaguccaccaagcuccggcuggccaccggccugcgcaacguccccagcauccagucccggggccucuucggcgcgaucgccggguucaucgagggcggcuggacggggaugguggacggcugguacggguaccaccaccagaacgagcagggcagcggguacgccgccgaccugaaguccacccagaacgccaucgacgagaucaccaacaaggugaacagcgucaucgagaagaugaacacccaguucacggcggugggcaaggaguucaaccaccuggagaagcgcaucgagaaccucaacaagaaggucgacgacggcuuccuggacaucuggaccuacaacgccgagcugcucgugcugcuggagaacgagcggacccucgacuaccacgacuccaacgugaagaaccuguacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcucaaccgggaggagaucgacggcgugaagcuggaguccacccgcaucuaccagauccuggccaucuacagcaccgucgcgagcucccucgugcugguggucagccugggggccaucuccuucuggaugugcagcaacggcucccuccagugccggaucugcaucuga

SEQ ID NO: 64587 - RNA, 1701 nt, Artificial Sequence; identical to SEQ ID NO: 63664
  derived and/or modified sequence opt1 from hemagglutinin__InfluenzaA__ACZ05071

SEQ ID NO: 64588 - RNA, 1701 nt, Artificial Sequence; identical to SEQ ID NO: 63664
  derived and/or modified sequence opt1 from hemagglutinin__InfluenzaA__ACZ05081

SEQ ID NO: 64589 - RNA, 1701 nt, Artificial Sequence; identical to SEQ ID NO: 63664
  derived and/or modified sequence opt1 from hemagglutinin__InfluenzaA__ACZ05091

SEQ ID NO: 64590 - RNA, 1701 nt, Artificial Sequence; identical to SEQ ID NO: 63664
  derived and/or modified sequence opt1 from hemagglutinin__InfluenzaA__ACZ05101

SEQ ID NO: 64591 - RNA, 1701 nt, Artificial Sequence; identical to SEQ ID NO: 63664
  derived and/or modified sequence opt1 from hemagglutinin__InfluenzaA__ACZ05111

SEQ ID NO: 64592 - RNA, 1701 nt, Artificial Sequence
  derived and/or modified sequence opt1 from hemagglutinin__InfluenzaA__ACZ05121
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaacaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcaugggguccgugaagaacggcaccuacgacuaccccaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacggcucccugcagugccggaucugcaucuga

SEQ ID NO: 64593 - RNA, 1701 nt, Artificial Sequence; identical to SEQ ID NO: 63664
  derived and/or modified sequence opt1 from hemagglutinin__InfluenzaA__ACZ05131

SEQ ID NO: 64594 - RNA, 1701 nt, Artificial Sequence; identical to SEQ ID NO: 63664
  derived and/or modified sequence opt1 from hemagglutinin__InfluenzaA__ACZ05141

SEQ ID NO: 64595 - RNA, 1701 nt, Artificial Sequence; identical to SEQ ID NO: 63664
  derived and/or modified sequence opt1 from hemagglutinin__InfluenzaA__ACZ05151

SEQ ID NO: 64596 - RNA, 1701 nt, Artificial Sequence
  derived and/or modified sequence opt1 from hemagglutinin__InfluenzaA__ACZ05172
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccaggacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 64597 - RNA, 1698 nt, Artificial Sequence; identical to SEQ ID NO: 64139
  derived and/or modified sequence opt1 from hemagglutinin__InfluenzaA__ACZ05194

SEQ ID NO: 64598 - RNA, 1701 nt, Artificial Sequence; identical to SEQ ID NO: 64596
  derived and/or modified sequence opt1 from hemagglutinin__InfluenzaA__ACZ05205

SEQ ID NO: 64599 - RNA, 1701 nt, Artificial Sequence
  derived and/or modified sequence opt1 from hemagglutinin__InfluenzaA__ACZ05216
augaagaccaucaucgcccugagcuacauccucugccugguguucgcccagaagauccccggcaacgacaacaacaccgcgacgcugugccucgggcaccacgccgucccgaacggcaccaucgugaagaccaucaccaacgaccagaucgaggugacgaacgccaccgagcugguccaguccagcuccaccggggagaucugcgacagcccccaccagauccuggacggcgagaacugcacccucaucgacgcccugcugggggacccccagugcgacggcuuccagaacaagaagugggaccucuucguggagcgcuccaaggccuacagcaacugcuaccccuacgacgugccggacuacgcgucccugcggagccuggucgccuccagcggcacgcucgaguucaacaacgaguccuucaacuggaccggggugacccagaacggcaccagcuccgccugcauccgccggagcaacaacuccuucuucagccgccugaacuggcugacgcaccucaaguucaaguaccccgcccugaacgugaccaugcccaacaacgagcaguucgacaagcuguacaucuggggcguccaccaccccgggaccgacaacgaccagaucuuccucuacgcgcaggccuccgggcggaucaccgugagcacgaagcgcucccagcagaccgugaucccgaacaucggcagccggccccgcguccggaacauccccagccgcaucuccaucuacuggaccaucgugaagcccggcgacauccugcugaucaacagcaccgggaaccucaucgccccgcggggcuacuucaagauccgcuccggcaagagcuccaucaugcggagcgacgcccccaucgggaagugcaacuccgagugcaucacgcccaacggcagcauccccaacgacaagccguuccagaacgugaaccgcaucaccuacggggccugcccccgguacgucaagcagaacacccugaagcuggcgaccggcaugcgcaacgugcccgagaagcagacgcgggggaucuucggcgccaucgccggguucaucgagaacggcugggagggcaugguggacgggugguacggcuuccgccaccagaacuccgaggggcggggccaggccgccgaccucaagagcacccaggcggccaucgaccagaucaacgggaagcugaaccgccugaucggcaagaccaacgagaaguuccaccagaucgagaaggaguucuccgaggucgagggccggauccaggaccucgagaaguacguggaggacaccaagaucgaccuguggagcuacaacgccgagcugcucguggcccuggagaaccagcacacgaucgaccugaccgacuccgagaugaacaagcuguucgagaagaccaagaagcagcuccgcgagaacgccgaggacauggggaacggcugcuucaagaucuaccacaagugcgacaacgcgugcaucgggagcauccgcaacggcaccuacgaccacgacgucuaccgggacgaggcccugaacaaccgcuuccagaucaaggggguggagcucaaguccggcuacaaggacuggauccuguggaucagcuucgccaucuccugcuuccugcucugcguggcccugcugggcuucaucaugugggccugccagaaggggaacauccggugcaacaucugcaucuga

SEQ ID NO: 64600 - RNA, 1701 nt, Artificial Sequence; identical to SEQ ID NO: 64596
  derived and/or modified sequence opt1 from hemagglutinin__InfluenzaA__ACZ05227

SEQ ID NO: 64601 - RNA, 1701 nt, Artificial Sequence
  derived and/or modified sequence opt1 from hemagglutinin__InfluenzaA__ACZ05238
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacugggccggggugacccagaacggcaccuccagcgccugcauccgccgguccaagaacagcuucuucucccgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcggaucaccguguccaccaagcgcagccagcagacggccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcgcccaucggcaagugcaacagcgagugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 64602 - RNA, 1701 nt, Artificial Sequence; identical to SEQ ID NO: 64596
  derived and/or modified sequence opt1 from hemagglutinin__InfluenzaA__ACZ05249

SEQ ID NO: 64603 - RNA, 1701 nt, Artificial Sequence; identical to SEQ ID NO: 64596
  derived and/or modified sequence opt1 from hemagglutinin__InfluenzaA__ACZ05260

SEQ ID NO: 64604 - RNA, 1701 nt, Artificial Sequence
  derived and/or modified sequence opt1 from hemagglutinin__InfluenzaA__ACZ05271
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcgagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaacaacagcuucuucucccgccugaacuggcucacgcaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucaccguguccacgaagcgcagccagcagaccgugaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggccugcccccgguacgucaagcagaacacccugaagcucgcgaccggcaugcgcaacgugcccgagcggcagacgcgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgccgaggacauggggaacggcugcuucaagaucuaccacaagugcgacaacgcgugcaucggguccauccggaacggcaccuacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 64605 - RNA, 1701 nt, Artificial Sequence
  derived and/or modified sequence opt1 from hemagglutinin__InfluenzaA__ACZ05282
augaagaccaccaucgcccugagcuacauccucugccugguguucgcccagaagcugcccggcaacgacaacuccacggcgacccucugccuggggcaccacgccgucccgaacggcaccaucgugaagaccaucacgaacgaccagaucgaggugaccaacgccaccgagcugguccagagcuccagcaccggggagaucugcgacagcccccaccagauccucgacggcgagaacugcacgcugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacccuggaguucaacaacgagagcuucaacuggaccggggugacccagaacggcacguccagcgccugcauccgccgguccaacaacagcuucuucucccgccugaacuggcucacccaccugaaguucaaguaccccgcccugaacgugaccaugcccaacaacgagcaguucgacaagcucuacaucuggggcguccaccaccccgggaccgacaacgaccagaucuuccuguacgcgcaggccagcgggcggaucacgguguccaccaagcgcagccagcagaccgugaucccgaacaucggcagccggccccgcguccggaacauccccucccgcaucagcaucuacuggaccaucgugaagcccggcgacauccugcucaucaacuccacggggaaccugaucgccccgcggggcuacuucaagauccagagcgggaaguccagcaucaugcgcuccgacgcccccaucggcaagugcaacagcgagugcaucacccccaacggcuccauccccaacgacaagccguuccagaacgugaaccggaucaccuacggggccugcccccgcuacgucaagcagaacacccugaagcucgcgacgggcaugcggaacgugcccgagaagcagacccgcgggaucuucggcgccaucgccggguucaucgagaacggcugggagggcaugguggacgggugguacggcuuccggcaccagaacagcgaggggcgcggccaggccgccgaccugaaguccacccaggcggccaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgggagaacgccgaggacauggggaacggcugcuucaagaucuaccacaagugcgacaacgcgugcaucggguccauccgcaacggcacguacgaccacgacgucuaccgcgacgaggcccucaacaaccgguuccagaucaaggggguggagcugaaguccggcuacaaggacuggauccuguggaucuccuucgccaucagcugcuuccuccugugcguggcccugcucggcuucaucaugugggccugccagaaggggaacauccgcugcaacaucugcaucuga

SEQ ID NO: 64606 - RNA, 1701 nt, Artificial Sequence; identical to SEQ ID NO: 64596
  derived and/or modified sequence opt1 from hemagglutinin__InfluenzaA__ACZ05304

SEQ ID NO: 64607 - RNA, 1701 nt, Artificial Sequence; identical to SEQ ID NO: 64419
  derived and/or modified sequence opt1 from hemagglutinin__InfluenzaA__ACZ05315

SEQ ID NO: 64608 - RNA, 1701 nt, Artificial Sequence; identical to SEQ ID NO: 64596
  derived and/or modified sequence opt1 from hemagglutinin__InfluenzaA__ACZ05326

SEQ ID NO: 64609 - RNA, 1701 nt, Artificial Sequence
  derived and/or modified sequence opt1 from hemagglutinin__InfluenzaA__ACZ05337
augaagaccaucaucgcccugagcuacauccucugccugguguucacccagaagcugcccggcaacgacaacuccacggccacccucugccuggggcaccacgcggucccgaacggcaccaucgugaagaccaucacgaacgaccagaucgaggugaccaacgccaccgagcugguccagagcuccagcaccggggagaucugcgacagcccccaccagauccucgacggcaagaacugcacgcugaucgacgcccugcucggggacccccagugcgacggcuuccagaacaagaagugggaccuguucguggagcgcagcaaggccuacuccaacugcuaccccuacgacgugccggacuacgccagccugcggucccucgucgcgagcuccggcacccuggaguucaacaacgagcgcuucaacuggaccggggugacccagaacggcacgagcuccgccugcauccggcgcagcaagaacuccuucuucagccggcugaacuggcucacccaccugaacuucaaguaccccgcccugaacgugaccaugcccaacaacgagcaguucgacaagcucuacaucuggggcguccaccaccccgggaccgacaaggaccagaucuuccuguacgcccaggcguccgggcgcaucacggugagcaccaagcggucccagcagaccgugaucccgaacaucggcagccgcccccggguccgcaacauccccagccggaucuccaucuacuggaccaucgugaagcccggcgacauccugcucaucagcuccacggggaaccugaucgccccgcgcggcuacuucaagauccggagcgggaaguccagcaucaugcgcuccgacgcccccaucggcaagugcaacagcgagugcaucacccccaacggcuccauccccaacgacaagccguuccagaacgugaaccggaucaccuacggggccugcccccgcuacgucaagcagaacacccugaagcucgccacgggcaugcggaacgugcccgagaagcagacccgcgggaucuucggcgcgaucgccggguucaucgagaacggcugggagggcaugguggacgggugguacggcuuccggcaccagaacagcgaggggcgcggccaggccgccgaccugaaguccacccaggccgcgaucgaccagaucaacgggaagcugaaccggcucaucggcaagaccaacgagaaguuccaccagaucgagaaggaguucagcgaggucgagggccgcauccaggaccuggagaaguacguggaggacacgaagaucgaccugugguccuacaacgccgagcuccugguggcccuggagaaccagcacaccaucgaccucaccgacagcgagaugaacaagcuguucgagaagaccaagaagcagcugcgcgagaacgccgaggacauggggaacggcugcuucaagaucuaccacaagugcgacaacgccugcaucggguccauccggaacggcacguacgaccacgacgucuaccgcgacgaggcgcucaacaaccgguuccagaucaaggggguggagcugaaguccggcuucaaggacuggauccuguggaucuccuucgccaucagcugcuuccuccugugcguggcccugcucggcuucaucaugugggccugccagaaggggaacauccgcugcaacaucugcaucuga

SEQ ID NO: 64610 - RNA, 1701 nt, Artificial Sequence; identical to SEQ ID NO: 64596
  derived and/or modified sequence opt1 from hemagglutinin__InfluenzaA__ACZ05348

SEQ ID NO: 64611 - RNA, 1701 nt, Artificial Sequence; identical to SEQ ID NO: 64601
  derived and/or modified sequence opt1 from hemagglutinin__InfluenzaA__ACZ05359

SEQ ID NO: 64612 - RNA, 1701 nt, Artificial Sequence; identical to SEQ ID NO: 64596
  derived and/or modified sequence opt1 from hemagglutinin__InfluenzaA__ACZ05370

SEQ ID NO: 64613 - RNA, 1701 nt, Artificial Sequence
  derived and/or modified sequence opt1 from hemagglutinin__InfluenzaA__ACZ05392
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcgccuccagcgccugcauccgccgguccaagaacagcuucuucucccgccugaacuggcucacccaccugaacuucaaguaccccgcgcugaacgugacgaugcccaacaacgagcaguucgacaagcucuacaucuggggcguccaccaccccgggaccgacaaggaccagaucuuccuguacgcccaggccagcgggcggaucaccguguccaccaagcgcagccagcagacggccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcgcccaucggcaagugcaacagcgagugcaucacccccaacggcuccauccccaacgacaagccguuccagaacgugaaccgcaucacguacggggccugcccccgguacgugaagcagaacacccugaagcucgccaccggcaugcgcaacguccccgagaagcagacccgggggaucuucggcgccaucgccggguucaucgagaacggcugggagggcaugguggacgggugguacggcuuccgccaccagaacagcgaggggcggggccaggcggccgaccugaaguccacgcaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacaccaucgaccucacggacagcgagaugaacaagcuguucgagaagaccaagaagcagcugcgcgagaacgccgaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcgcugcucggcuucaucaugugggccugccagaaggggaacauccggugcaacaucugcaucuga

SEQ ID NO: 64614 - RNA, 1701 nt, Artificial Sequence; identical to SEQ ID NO: 64596
  derived and/or modified sequence opt1 from hemagglutinin__InfluenzaA__ACZ05403

SEQ ID NO: 64615 - RNA, 1701 nt, Artificial Sequence
  derived and/or modified sequence opt1 from hemagglutinin__InfluenzaA__ACZ05436
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagagcugcacccugaucgacgcccugcucggggacccccagugcgacggcuuccagaacaagaagugggaccuguucguggagcgcuccaaggccuacagcaacugcuaccccuacgacgugccggacuacgcgucccugcggagccucgucgccuccagcggcacgcuggaguucaacaacgaguccuucaacuggaccggggugacccagaacggcaccagcuccgccugcauccgccggagcaagaacuccuucuucagccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccuccgggcggaucaccgugagcacgaagcgcagccagcagaccgccaucccgaacaucggcucccggccccgcgugcggaacauccccagccgcaucuccaucuacuggaccaucgucaagcccggcgacauccugcucaucaacagcaccgggaaccugaucgccccgcggggcuacuucaagauccgcuccgggaaguccuccaucaugcggagcgacgcccccaucggcaagugcaacuccgagugcaucacgcccaacggcagcauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacuccgaggggcggggccaggccgcggaccucaagagcacccaggccgccaucgaccagaucaacgggaagcugaaccgccugaucggcaagaccaacgagaaguuccaccagaucgagaaggaguucuccgagguggagggccggauccaggaccuggagaaguacgucgaggacaccaagaucgaccuguggagcuacaacgccgagcuccugguggcccuggagaaccagcacacgaucgaccucaccgacuccgagaugaacaagcuguucgagaagaccaagaagcagcugcgcgagaacgcggaggacauggggaacggcugcuucaagaucuaccacaagugcgacaacgccugcaucgggagcauccgcaacggcaccuacgaccacgacguguaccgggacgaggcccucaacaaccgcuuccagaucaagggggucgagcugaaguccggcuacaaggacuggauccuguggaucagcuucgccaucuccugcuuccuccugugcguggcccugcucggcuucaucaugugggcgugccagaaggggaacauccggugcaacaucugcaucuga

SEQ ID NO: 64616 - RNA, 1701 nt, Artificial Sequence; identical to SEQ ID NO: 64596
  derived and/or modified sequence opt1 from hemagglutinin__InfluenzaA__ACZ05458

SEQ ID NO: 64617 - RNA, 1701 nt, Artificial Sequence; identical to SEQ ID NO: 64596
  derived and/or modified sequence opt1 from hemagglutinin__InfluenzaA__ACZ05469

SEQ ID NO: 64618 - RNA, 1701 nt, Artificial Sequence; identical to SEQ ID NO: 64615
  derived and/or modified sequence opt1 from hemagglutinin__InfluenzaA__ACZ05480

SEQ ID NO: 64619 - RNA, 1701 nt, Artificial Sequence; identical to SEQ ID NO: 64419
  derived and/or modified sequence opt1 from hemagglutinin__InfluenzaA__ACZ05513

SEQ ID NO: 64620 - RNA, 1701 nt, Artificial Sequence; identical to SEQ ID NO: 64596
  derived and/or modified sequence opt1 from hemagglutinin__InfluenzaA__ACZ05524

SEQ ID NO: 64621 - RNA, 1701 nt, Artificial Sequence
  derived and/or modified sequence opt1 from hemagglutinin__InfluenzaA__ACZ05535
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 64622 - RNA, 1701 nt, Artificial Sequence; identical to SEQ ID NO: 64621
  derived and/or modified sequence opt1 from hemagglutinin__InfluenzaA__ACZ05546

SEQ ID NO: 64623 - RNA, 1701 nt, Artificial Sequence; identical to SEQ ID NO: 64596
  derived and/or modified sequence opt1 from hemagglutinin__InfluenzaA__ACZ05557

SEQ ID NO: 64624 - RNA, 1698 nt, Artificial Sequence
  derived and/or modified sequence opt1 from hemagglutinin__InfluenzaA__ACZ05579
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgugaagaacgggcuguaccccaaccugagcaaguccuacgccaacaacaaggagaaggagguccucgugcuguggggcgugcaccacccgcccaacaucgucgaccagaagacccuguaccggacggagaacgccuacgugagcguggucagcucccacuacagccgcaaguucacccccgagaucgccaagcggcccaaggugcgcgaccaggaggggcggaucaacuacuacuggacccuccuggagcccggcgacaccaucaucuucgaggccaacggcaaccugaucgcgccgcgcuacgccuucgcccucucccggggguucggcagcgggaucaucaacuccaacgcccccauggacaagugcgacgccaagugccagacgccccgcggcgcgaucaacagcucccugcccuuccagaacgugcacccggucaccaucggcgagugccccaaguacgugcggagcgccaagcugcgcauggugaccgggcuccggaacauccccuccauccagagccgcggccuguucggggccaucgccggcuucaucgagggcggcuggaccggcauggucgacgggugguacggcuaccaccaccagaacgagcagggguccggcuacgccgcggaccagaaguccacgcagaacgccaucaacgggaucaccaacaaggugaacagcgucaucgagaagaugaacacccaguucaccgccgugggcaaggaguucaacaagcuggagcggcgcauggagaaccucaacaagaagguggacgacggcuucaucgacaucuggacguacaacgccgagcugcugguccuccuggagaacgagcggacccuggacuuccacgacagcaacgugaagaaccucuacgagaaggugaagucccagcugaagaacaacgccaaggagaucgggaacggcugcuucgaguucuaccacaagugcaacgacgagugcauggagagcgucaagaacgggaccuacgacuaccccaaguacuccgaggagagcaagcugaaccgcgagaagaucgacggcgugaagcucgaguccauggggguguaccagauccuggcgaucuacagcaccgucgccagcucccuggugcuccuggugagccugggcgccaucuccuucuggaugugcagcaacggcucccuccagugccggaucugcaucuga

SEQ ID NO: 64625 - RNA, 1698 nt, Artificial Sequence
  derived and/or modified sequence opt1 from hemagglutinin__InfluenzaA__ACZ05590
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagagcuccuucuaccgcaaccugcuguggcucaccgggaagaacggccuguaccccaaccugagcaaguccuacgccaacaacaaggagaaggaggugcucguccuguggggcgugcaccacccgcccagcaucagcgaccagaagacccuguaccacacggaggacgccuacguguccgucgugagcucccacuacagccggaaguucacccccgagaucgccaagcgccccaaggugcgggaccaggagggccgcaucaacuacuacuggacccuccuggagcccggcgacaccaucaucuucgaggccaacgggaaccugaucgcgccgcgguacgccuucgcccucucccgcggcuucgggagcggcaucaucaacuccaacgcccccaugggcaagugcgacgccaagugccagacgccccagggggcgaucaacagcucccugcccuuccagaacguccacccggugaccaucggcgagugccccaaguacgugcggagcgccaagcugcgcauggucaccgggcuccggaacauccccuccauccagagccgcggccuguucggggccaucgccggcuucaucgagggcggguggaccggcaugguggacgggugguacggcuaccaccaccagaacgagcagggguccggcuacgccgcggaccagaaguccacgcagaacgccaucaacggcaucaccaacaaggugaacagcgucaucgagaagaugaacacccaguucaccgccguggggaaggaguucaacaagcuggagcggcgcauggagaaccucaacaagaaggucgacgacggcuucaucgacaucuggacguacaacgccgagcugcuggugcuccuggagaacgagcggacccuggacuuccacgacagcaacgugaagaaccucuacgagaaggucaagucccagcugaagaacaacgccaaggagaucgggaacggcugcuucgaguucuaccacaagugcaacgacgagugcauggagagcgugaagaacgggaccuacgacuaccccaaguacuccgaggagagcaagcugaaccgcgagaagaucgacggcgugaagcucgagagcaugggcgucuaccagauccuggcgaucuacuccaccguggccagcucccuggugcuccuggucagccugggggccaucuccuucuggaugugcagcaacggcucccuccagugccggaucugcaucuga

SEQ ID NO: 64626 - RNA, 1701 nt, Artificial Sequence; identical to SEQ ID NO: 64621
  derived and/or modified sequence opt1 from hemagglutinin__InfluenzaA__ACZ05950

SEQ ID NO: 64627 - RNA, 1701 nt, Artificial Sequence; identical to SEQ ID NO: 64596
  derived and/or modified sequence opt1 from hemagglutinin__InfluenzaA__ACZ05961

SEQ ID NO: 64628 - RNA, 1701 nt, Artificial Sequence
  derived and/or modified sequence opt1 from hemagglutinin__InfluenzaA__ACZ05972
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcucccuccugugcguggcccugcucggcuucaucaugugggcgugccagaaggggaacauccggugcaacaucugcaucuga

SEQ ID NO: 64629 - RNA, 1701 nt, Artificial Sequence
  derived and/or modified sequence opt1 from hemagglutinin__InfluenzaA__ACZ05983
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaacaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 64630 - RNA, 1701 nt, Artificial Sequence
  derived and/or modified sequence opt1 from hemagglutinin__InfluenzaA__ACZ05994
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccagugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccguccccaacaacgagcaguucgacaagcucuacaucuggggcgugcaccaccccgggaccgacaaggaccagaucuuccuguacgcgcaggccagcgggcggaucaccguguccacgaagcgcagccagcagaccgccaucccgaacaucggcagccggccccgcguccggaacauccccucccgcaucagcaucuacuggaccaucgugaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgucaagcagaacacccugaagcucgccaccggcaugcgcaacgugcccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacgucuaccgggacgaggcccucaacaaccgcuuccagaucaaggggguggagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 64631 - RNA, 1701 nt, Artificial Sequence; identical to SEQ ID NO: 64596
  derived and/or modified sequence opt1 from hemagglutinin__InfluenzaA__ACZ06005

SEQ ID NO: 64632 - RNA, 1701 nt, Artificial Sequence; identical to SEQ ID NO: 64596
  derived and/or modified sequence opt1 from hemagglutinin__InfluenzaA__ACZ06016

SEQ ID NO: 64633 - RNA, 1698 nt, Artificial Sequence
  derived and/or modified sequence opt1 from hemagglutinin__InfluenzaA__ACZ16013
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccgaccagaagacccuguaccacacggagaaggccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccagcagccuggugcuccuggucucccugggcgccaucagcuucuggaugugcuccaacgggagccuccagugccggaucugcaucuga

SEQ ID NO: 64634 - RNA, 1698 nt, Artificial Sequence
  derived and/or modified sequence opt1 from hemagglutinin__InfluenzaA__ACZ16023
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccgaccagaagacccuguaccacacggagaacgccuacguguccgucgugagcagccacuacucccggaaguucacccccgagaucgccaagcgccccaaggugcgggaccaggagggccgcaucaacuacuacuggacccuccuggagcccggcgacaccaucaucuucgaggcgaacgggaaccugaucgccccgcgguacgccuucgcccucagccgcggcuucggguccggcaucaucaacagcaacgcccccauggacaagugcgacgcgaagugccagacgccccagggcgccaucaacuccagccugcccuuccagaacguccacccggugaccaucggggagugccccaaguacgugcgguccgccaagcugcgcauggucaccggccuccggaacauccccagcauccagucccgcgggcuguucggcgccaucgccggguucaucgagggcggcuggaccgggaugguggacggcugguacggguaccaccaccagaacgagcagggcagcggguacgcggccgaccagaaguccacgcagaacgccaucaacggcaucaccaacaaggugaacagcgucaucgagaagaugaacacccaguucaccgccgugggcaaggaguucaacaagcuggagcggcgcauggagaaccucaacaagaaggucgacgacggguucaucgacaucuggacguacaacgccgagcugcuggugcuccuggagaacgagcggacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcgucuaccagauccuggccaucuacuccaccguggccagcagccuggugcuccuggucucccugggcgccaucagcuucuggaugugcuccaacgggagccuccagugccggaucugcaucuga

SEQ ID NO: 64635 - RNA, 1698 nt, Artificial Sequence
  derived and/or modified sequence opt1 from hemagglutinin__InfluenzaA__ACZ16033
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggggccuccgccagcugcucccacaacggcgagaacagcuucuaccgcaaccugcuguggcucaccgggaagaacggccuguaccccaaccuguccaagagcuacgccaacaacaaggagaaggaggugcucgugcuguggggcguccaccacccgcccaacaucgccgaccagaagacccuguaccacacggagaacgccuacguguccguggucagcagccacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacagcaacgcgcccauggacaagugcgacgccaagugccagacgccccagggcgccaucaacuccagccugcccuuccagaacauccacccggugaccaucggggagugccccaaguacguccgguccgccaagcugcgcauggugaccggccuccggaacauccccagcauccagucccgcgggcuguucggcgccaucgcgggguucaucgagggcggcuggaccgggaugguggacggcugguacggguaccaccaccagaacgagcagggcagcggguacgccgccgaccagaaguccacgcagaacgccaucaacggcaucaccaacaaggucaacagcgugaucgagaagaugaacacccaguucaccgccgugggcaaggaguucaacaagcuggagcggcgcauggagaaccucaacaagaaggucgacgacggguucaucgacaucuggacguacaacgcggagcugcuggugcuccuggagaacgagcggacccuggacuuccacgacuccaacgucaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaacaaggagaagaucgacggggugaagcucgagagcaugggcguguaccagauccuggccaucuacuccaccguggccagcagccugguccuccuggugucccugggcgccaucagcuucuggaugugcuccaacgggagccuccagugccgcaucugcaucuga

SEQ ID NO: 64636 - RNA, 1701 nt, Artificial Sequence; identical to SEQ ID NO: 63664
  derived and/or modified sequence opt1 from hemagglutinin__InfluenzaA__ACZ16040

SEQ ID NO: 64637 - RNA, 1701 nt, Artificial Sequence; identical to SEQ ID NO: 63664
  derived and/or modified sequence opt1 from hemagglutinin__InfluenzaA__ACZ16050

SEQ ID NO: 64638 - RNA, 1701 nt, Artificial Sequence; identical to SEQ ID NO: 63664
  derived and/or modified sequence opt1 from hemagglutinin__InfluenzaA__ACZ16060

SEQ ID NO: 64639 - RNA, 1701 nt, Artificial Sequence
  derived and/or modified sequence opt1 from hemagglutinin__InfluenzaA__ACZ16070
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugagccugcuggaggacaagcacaacgggaagcucugcaagcugcgcggcgucgcgccccugcaccucgggaagugcaacaucgccggcuggauccuggggaacccggagugcgagucccugagcaccgcguccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacagcaccgucgccuccagccuggugcucguggucucccugggggccaucagcuucuggaugugcuccaacggcagccugcagugccggaucugcaucuga

SEQ ID NO: 64640 - RNA, 1701 nt, Artificial Sequence
  derived and/or modified sequence opt1 from hemagglutinin__InfluenzaA__ACZ16080
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgacgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 64641 - RNA, 1701 nt, Artificial Sequence
  derived and/or modified sequence opt1 from hemagglutinin__InfluenzaA__ACZ16090
augaaggccauccugcucgugcugcuguacaccuucgccaccgcgaacgccgacacgcucugcaucggcuaccacgccaacaacagcaccgacaccgucgacaccgugcuggagaagaacgugacggucacccacuccgugaaccugcucgaggacaagcacaacgggaagcugugcaagcugcgcggcguggcgccccuccaccuggggaagugcaacaucgccggcuggauccuggggaacccggagugcgagagccucuccaccgccagcuccuggagcuacaucgucgagaccuccagcuccgacaacggcacgugcuaccccggcgacuucaucgacuacgaggagcugcgggagcagcugagcuccaugagcuccuucgagcgcuucgagaucuuccccaagaccagcuccuggcccaaccacgacagcaacaagggggugaccgccgccugcccgcacgccggcgcgaaguccuucuacaagaaccucaucuggcuggugaagaaggggaacagcuaccccaagcuguccaagagcuacaucaacgacaagggcaaggagguccucgugcugugggggauccaccaccccagcaccuccgccgaccagcagagccuguaccagaacgccgacgccuacguguucgucggcuccagccgguacuccaagaaguucaagcccgagaucgccauccgcccgaaggugcgggaccaggagggccgcaugaacuacuacuggacgcucguggagcccggggacaagaucaccuucgaggcgaccggcaaccuggucgugccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgucaaguccaccaagcuccggcuggcgaccggccugcgcaacgugccgagcauccagucccggggccucuucggggccaucgccggguucaucgagggcggcuggaccgggaugguggacggcugguacggguaccaccaccagaacgagcagggcagcggguacgccgccgaccugaaguccacgcagaacgcgaucgacgagaucaccaacaaggucaacagcgugaucgagaagaugaacacccaguucaccgccgugggcaaggaguucaaccaccuggagaagcgcaucgagaaccucaacaagaaggucgacgacggcuuccuggacaucuggacguacaacgccgagcugcucgugcugcuggagaacgagcggacccucgacuaccacgacuccaacgucaagaaccuguacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcucaaccgggaggagaucgacggcgucaagcuggaguccacccgcaucuaccagauccuggcgaucuacagcaccguggccagcucccucgugcuggucgugagccugggggccaucuccuucuggaugugcagcaacggcucccuccagugccggaucugcaucuga

SEQ ID NO: 64642 - RNA, 1701 nt, Artificial Sequence; identical to SEQ ID NO: 63664
  derived and/or modified sequence opt1 from hemagglutinin__InfluenzaA__ACZ16100

SEQ ID NO: 64643 - RNA, 1701 nt, Artificial Sequence; identical to SEQ ID NO: 63664
  derived and/or modified sequence opt1 from hemagglutinin__InfluenzaA__ACZ16110

SEQ ID NO: 64644 - RNA, 1701 nt, Artificial Sequence; identical to SEQ ID NO: 63664
  derived and/or modified sequence opt1 from hemagglutinin__InfluenzaA__ACZ16120

SEQ ID NO: 64645 - RNA, 1701 nt, Artificial Sequence; identical to SEQ ID NO: 64412
  derived and/or modified sequence opt1 from hemagglutinin__InfluenzaA__ACZ16130

SEQ ID NO: 64646 - RNA, 1701 nt, Artificial Sequence; identical to SEQ ID NO: 63664
  derived and/or modified sequence opt1 from hemagglutinin__InfluenzaA__ACZ16140

SEQ ID NO: 64647 - RNA, 1701 nt, Artificial Sequence; identical to SEQ ID NO: 63664
  derived and/or modified sequence opt1 from hemagglutinin__InfluenzaA__ACZ16150

SEQ ID NO: 64648 - RNA, 1701 nt, Artificial Sequence; identical to SEQ ID NO: 63664
  derived and/or modified sequence opt1 from hemagglutinin__InfluenzaA__ACZ16160

SEQ ID NO: 64649 - RNA, 1701 nt, Artificial Sequence; identical to SEQ ID NO: 63857
  derived and/or modified sequence opt1 from hemagglutinin__InfluenzaA__ACZ16170

SEQ ID NO: 64650 - RNA, 1701 nt, Artificial Sequence
  derived and/or modified sequence opt1 from hemagglutinin__InfluenzaA__ACZ16180
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguacaccgcguccagcugguccuacaucguggagaccagcuccagcgacaacggcacgugcuaccccggcgacuucaucgacuacgaggagcuccgggagcagcuguccagcguguccagcuucgagcgcuucgagaucuuccccaagaccuccagcuggcccaaccacgacuccaacaagggggucaccgccgccugcccgcacgccggcgccaagagcuucuacaagaaccugaucuggcucgugaagaaggggaacuccuaccccaagcugagcaaguccuacaucaacgacaagggcaaggaggugcugguccucugggggauccaccaccccagcaccagcgccgaccagcagucccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64651 - RNA, 1701 nt, Artificial Sequence; identical to SEQ ID NO: 63664
  derived and/or modified sequence opt1 from hemagglutinin__InfluenzaA__ACZ16190

SEQ ID NO: 64652 - RNA, 1701 nt, Artificial Sequence
  derived and/or modified sequence opt1 from hemagglutinin__InfluenzaA__ACZ16200
augaaggccauccuggugguccuccuguacaccuucgccaccgcgaaccccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgccccgcugcaccucgggaagugcaacaucgccggcuggauccuggggaaccccgagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggccgaaccacgacagcaacaagggggucaccgcggccugcccccacgccggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgcggaccagcagagccuguaccagaacgccgacgccuacguguucgugggcuccagccgguacuccaagaaguucaagccggagaucgccauccgccccaagguccgggaccaggagggccgcaugaacuacuacuggacgcugguggagcccggggacaagaucaccuucgaggccaccggcaaccucguggucccccgguacgcguucgccauggagcgcaacgccgggagcggcaucaucaucuccgacaccccggugcacgacugcaacacgaccugccagacccccaagggcgccaucaacaccagccugcccuuccagaacauccaccccaucacgaucgggaagugcccgaaguacgugaaguccaccaagcugcggcucgccaccggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 64653 - RNA, 1701 nt, Artificial Sequence; identical to SEQ ID NO: 63664
  derived and/or modified sequence opt1 from hemagglutinin__InfluenzaA__ACZ16210

SEQ ID NO: 64654 - RNA, 1701 nt, Artificial Sequence; identical to SEQ ID NO: 63664
  derived and/or modified sequence opt1 from hemagglutinin__InfluenzaA__ACZ16220

SEQ ID NO: 64655 - RNA, 1701 nt, Artificial Sequence; identical to SEQ ID NO: 64412
  derived and/or modified sequence opt1 from hemagglutinin__InfluenzaA__ACZ16230

SEQ ID NO: 64656 - RNA, 1701 nt, Artificial Sequence
  derived and/or modified sequence opt1 from hemagglutinin__InfluenzaA__ACZ16240
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcuguucggcgccaucgccggguucaucgagggcggcuggaccgggaugguggacggcugguacggguaccaccaccagaacgagcagggcagcggguacgccgccgaccugaaguccacgcagaacgcgcucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64657 - RNA, 1701 nt, Artificial Sequence; identical to SEQ ID NO: 63664
  derived and/or modified sequence opt1 from hemagglutinin__InfluenzaA__ACZ16260

SEQ ID NO: 64658 - RNA, 1701 nt, Artificial Sequence
  derived and/or modified sequence opt1 from hemagglutinin__InfluenzaA__ACZ16270
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagaaccuguaccagaacgccgacgccuacguguucgugggcagcucccgguacagcaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgcgaccggccugcgcaacgugccguccauccagagccgggggcuguucggcgccaucgccggguucaucgagggcggcuggaccgggaugguggacggcugguacggguaccaccaccagaacgagcagggcuccggguacgccgccgaccucaagagcacgcagaacgcgaucgacgagaucaccaacaaggugaacuccgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccugauccucguggugucccugggggccaucagcuucuggaugugcuccaacggcagccugcagugccggaucugcaucuga

SEQ ID NO: 64659 - RNA, 1701 nt, Artificial Sequence; identical to SEQ ID NO: 64339
  derived and/or modified sequence opt1 from hemagglutinin__InfluenzaA__ACZ16280

SEQ ID NO: 64660 - RNA, 1701 nt, Artificial Sequence; identical to SEQ ID NO: 63664
  derived and/or modified sequence opt1 from hemagglutinin__InfluenzaA__ACZ16290

SEQ ID NO: 64661 - RNA, 1701 nt, Artificial Sequence
  derived and/or modified sequence opt1 from hemagglutinin__InfluenzaA__ACZ16300
augaaggccauccuggugguccuccuguacaccuucgccaccgcgaacgccgacacgcugugcaucggcuaccacgccaacaacagcaccgacaccguggacaccgugcucgagaagaacgucaucgugacgcacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacgggaccugcuaccccggcgacuucaucgacuacgaggagcuccgggagcagcugagcuccgugagcuccuucgagcgcuucgagaucuuccccaagacgagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacccugguggagcccggggacaagaucacguucgaggcgaccggcaaccuccuggugccccgguacgccuucgccauggagcgcaacgccgggagcggcaucaucaucuccgacacccccguccacgacugcaacaccacgugccagaccccgaagggcgccaucaacaccagccugcccuuccagaacauccaccccaucaccaucgggaagugccccaaguacgugaaguccacgaagcuccggcuggcgaccggccugcgcaacgugccgagcauccagucccggggccucuucggcgccaucgccggguucaucgagggcggcuggaccgggauggucgacggcugguacggguaccaccaccagaacgagcagggcagcggguacgccgccgaccugaaguccacccagaacgcgaucgacgagaucacgaacaaggugaacagcgugaucgagaagaugaacacccaguucaccgccgucggcaaggaguucaaccaccuggagaagcgcaucgagaaccucaacaagaagguggacgacggcuuccuggacaucuggaccuacaacgccgagcugcucguccugcuggagaacgagcggacgcucgacuaccacgacuccaacgugaagaaccuguacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcucaaccgggaggagaucgacggcgugaagcuggaguccacccgcaucuaccagauccuggcgaucuacagcaccguggccagcucccucguccugguggugagccugggggccaucuccuucuggaugugcagcaacggcucccuccagugccggaucugcaucuga

SEQ ID NO: 64662 - RNA, 1701 nt, Artificial Sequence; identical to SEQ ID NO: 64407
  derived and/or modified sequence opt1 from hemagglutinin__InfluenzaA__ACZ16310

SEQ ID NO: 64663 - RNA, 1701 nt, Artificial Sequence
  derived and/or modified sequence opt1 from hemagglutinin__InfluenzaA__ACZ16320
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccacccggcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 64664 - RNA, 1701 nt, Artificial Sequence; identical to SEQ ID NO: 64407
  derived and/or modified sequence opt1 from hemagglutinin__InfluenzaA__ACZ16330

SEQ ID NO: 64665 - RNA, 1701 nt, Artificial Sequence; identical to SEQ ID NO: 63857
  derived and/or modified sequence opt1 from hemagglutinin__InfluenzaA__ACZ16340

SEQ ID NO: 64666 - RNA, 1701 nt, Artificial Sequence; identical to SEQ ID NO: 63664
  derived and/or modified sequence opt1 from hemagglutinin__InfluenzaA__ACZ16350

SEQ ID NO: 64667 - RNA, 1701 nt, Artificial Sequence; identical to SEQ ID NO: 63664
  derived and/or modified sequence opt1 from hemagglutinin__InfluenzaA__ACZ16360

SEQ ID NO: 64668 - RNA, 1701 nt, Artificial Sequence; identical to SEQ ID NO: 63857
  derived and/or modified sequence opt1 from hemagglutinin__InfluenzaA__ACZ16370

SEQ ID NO: 64669 - RNA, 1701 nt, Artificial Sequence; identical to SEQ ID NO: 63664
  derived and/or modified sequence opt1 from hemagglutinin__InfluenzaA__ACZ16380

SEQ ID NO: 64670 - RNA, 1701 nt, Artificial Sequence; identical to SEQ ID NO: 63664
  derived and/or modified sequence opt1 from hemagglutinin__InfluenzaA__ACZ16390

SEQ ID NO: 64671 - RNA, 1701 nt, Artificial Sequence; identical to SEQ ID NO: 63664
  derived and/or modified sequence opt1 from hemagglutinin__InfluenzaA__ACZ16400

SEQ ID NO: 64672 - RNA, 1701 nt, Artificial Sequence; identical to SEQ ID NO: 63664
  derived and/or modified sequence opt1 from hemagglutinin__InfluenzaA__ACZ16410

SEQ ID NO: 64673 - RNA, 1701 nt, Artificial Sequence; identical to SEQ ID NO: 64301
  derived and/or modified sequence opt1 from hemagglutinin__InfluenzaA__ACZ16420

SEQ ID NO: 64674 - RNA, 1701 nt, Artificial Sequence; identical to SEQ ID NO: 63664
  derived and/or modified sequence opt1 from hemagglutinin__InfluenzaA__ACZ16430

SEQ ID NO: 64675 - RNA, 1701 nt, Artificial Sequence; identical to SEQ ID NO: 63664
  derived and/or modified sequence opt1 from hemagglutinin__InfluenzaA__ACZ16440

SEQ ID NO: 64676 - RNA, 1701 nt, Artificial Sequence
  derived and/or modified sequence opt1 from hemagglutinin__InfluenzaA__ACZ16450
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcuggugaagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64677 - RNA, 1701 nt, Artificial Sequence; identical to SEQ ID NO: 63857
  derived and/or modified sequence opt1 from hemagglutinin__InfluenzaA__ACZ16460

SEQ ID NO: 64678 - RNA, 1701 nt, Artificial Sequence; identical to SEQ ID NO: 63664
  derived and/or modified sequence opt1 from hemagglutinin__InfluenzaA__ACZ16470

SEQ ID NO: 64679 - RNA, 1701 nt, Artificial Sequence; identical to SEQ ID NO: 63664
  derived and/or modified sequence opt1 from hemagglutinin__InfluenzaA__ACZ16480

SEQ ID NO: 64680 - RNA, 1701 nt, Artificial Sequence; identical to SEQ ID NO: 64412
  derived and/or modified sequence opt1 from hemagglutinin__InfluenzaA__ACZ16490

SEQ ID NO: 64681 - RNA, 1701 nt, Artificial Sequence; identical to SEQ ID NO: 63664
  derived and/or modified sequence opt1 from hemagglutinin__InfluenzaA__ACZ16500

SEQ ID NO: 64682 - RNA, 1701 nt, Artificial Sequence; identical to SEQ ID NO: 63857
  derived and/or modified sequence opt1 from hemagglutinin__InfluenzaA__ACZ16510

SEQ ID NO: 64683 - RNA, 1701 nt, Artificial Sequence; identical to SEQ ID NO: 63664
  derived and/or modified sequence opt1 from hemagglutinin__InfluenzaA__ACZ16530

SEQ ID NO: 64684 - RNA, 1701 nt, Artificial Sequence
  derived and/or modified sequence opt1 from hemagglutinin__InfluenzaA__ACZ16540
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaacauccuggaggacaagcacaacgggaagcugugcaagcuccgcggcgucgcgccccugcaccuggggaagugcaacaucgccggcuggauccucgggaacccggagugcgagagccuguccaccgccagcuccuggagcuacaucguggagaccuccagcuccgacaacggcacgugcuaccccggcgacuucaucgacuacgaggagcugcgggagcagcucagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcuggugaagaaggggaacagcuaccccaagcucuccaagagcuacaucaacgacaagggcaaggaggugcugguccugugggggauccaccaccccagcaccuccgccgaccagcagagccucuaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccugguggucccccgguacgccuucgccauggagcgcaacgccgggagcggcaucaucaucuccgacacccccgugcacgacugcaacacgaccugccagaccccgaagggcgccaucaacaccagccuccccuuccagaacauccaccccaucacgaucgggaagugccccaaguacgugaaguccaccaagcugcggcuggcgaccggccuccgcaacgucccgagcauccagucccgggggcugcugggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64685 - RNA, 1701 nt, Artificial Sequence; identical to SEQ ID NO: 64407
  derived and/or modified sequence opt1 from hemagglutinin__InfluenzaA__ACZ16550

SEQ ID NO: 64686 - RNA, 1701 nt, Artificial Sequence; identical to SEQ ID NO: 63664
  derived and/or modified sequence opt1 from hemagglutinin__InfluenzaA__ACZ16583

SEQ ID NO: 64687 - RNA, 1701 nt, Artificial Sequence; identical to SEQ ID NO: 64407
  derived and/or modified sequence opt1 from hemagglutinin__InfluenzaA__ACZ16593

SEQ ID NO: 64688 - RNA, 1701 nt, Artificial Sequence; identical to SEQ ID NO: 63664
  derived and/or modified sequence opt1 from hemagglutinin__InfluenzaA__ACZ16603

SEQ ID NO: 64689 - RNA, 1701 nt, Artificial Sequence; identical to SEQ ID NO: 64407
  derived and/or modified sequence opt1 from hemagglutinin__InfluenzaA__ACZ16630

SEQ ID NO: 64690 - RNA, 1701 nt, Artificial Sequence; identical to SEQ ID NO: 63664
  derived and/or modified sequence opt1 from hemagglutinin__InfluenzaA__ACZ16640

SEQ ID NO: 64691 - RNA, 1701 nt, Artificial Sequence; identical to SEQ ID NO: 63664
  derived and/or modified sequence opt1 from hemagglutinin__InfluenzaA__ACZ16650

SEQ ID NO: 64692 - RNA, 1701 nt, Artificial Sequence; identical to SEQ ID NO: 63664
  derived and/or modified sequence opt1 from hemagglutinin__InfluenzaA__ACZ16660

SEQ ID NO: 64693 - RNA, 1701 nt, Artificial Sequence; identical to SEQ ID NO: 63664
  derived and/or modified sequence opt1 from hemagglutinin__InfluenzaA__ACZ16670

SEQ ID NO: 64694 - RNA, 1701 nt, Artificial Sequence; identical to SEQ ID NO: 63664
  derived and/or modified sequence opt1 from hemagglutinin__InfluenzaA__ACZ16680

SEQ ID NO: 64695 - RNA, 1701 nt, Artificial Sequence; identical to SEQ ID NO: 63664
  derived and/or modified sequence opt1 from hemagglutinin__InfluenzaA__ACZ16690

SEQ ID NO: 64696 - RNA, 1701 nt, Artificial Sequence; identical to SEQ ID NO: 63664
  derived and/or modified sequence opt1 from hemagglutinin__InfluenzaA__ACZ16700

SEQ ID NO: 64697 - RNA, 1701 nt, Artificial Sequence; identical to SEQ ID NO: 63664
  derived and/or modified sequence opt1 from hemagglutinin__InfluenzaA__ACZ16710

SEQ ID NO: 64698 - RNA, 1701 nt, Artificial Sequence; identical to SEQ ID NO: 63664
  derived and/or modified sequence opt1 from hemagglutinin__InfluenzaA__ACZ16720

SEQ ID NO: 64699 - RNA, 1701 nt, Artificial Sequence; identical to SEQ ID NO: 64407
  derived and/or modified sequence opt1 from hemagglutinin__InfluenzaA__ACZ16730

SEQ ID NO: 64700 - RNA, 1701 nt, Artificial Sequence; identical to SEQ ID NO: 64407
  derived and/or modified sequence opt1 from hemagglutinin__InfluenzaA__ACZ16740

SEQ ID NO: 64701 - RNA, 1701 nt, Artificial Sequence; identical to SEQ ID NO: 63664
  derived and/or modified sequence opt1 from hemagglutinin__InfluenzaA__ACZ16750

SEQ ID NO: 64702 - RNA, 1701 nt, Artificial Sequence; identical to SEQ ID NO: 63664
  derived and/or modified sequence opt1 from hemagglutinin__InfluenzaA__ACZ16760

SEQ ID NO: 64703 - RNA, 1701 nt, Artificial Sequence; identical to SEQ ID NO: 63857
  derived and/or modified sequence opt1 from hemagglutinin__InfluenzaA__ACZ16770

SEQ ID NO: 64704 - RNA, 1701 nt, Artificial Sequence; identical to SEQ ID NO: 63664
  derived and/or modified sequence opt1 from hemagglutinin__InfluenzaA__ACZ16780

SEQ ID NO: 64705 - RNA, 1701 nt, Artificial Sequence; identical to SEQ ID NO: 63664
  derived and/or modified sequence opt1 from hemagglutinin__InfluenzaA__ACZ16790

SEQ ID NO: 64706 - RNA, 1701 nt, Artificial Sequence; identical to SEQ ID NO: 63664
  derived and/or modified sequence opt1 from hemagglutinin__InfluenzaA__ACZ16800

SEQ ID NO: 64707 - RNA, 1701 nt, Artificial Sequence; identical to SEQ ID NO: 63664
  derived and/or modified sequence opt1 from hemagglutinin__InfluenzaA__ACZ16810

SEQ ID NO: 64708 - RNA, 1701 nt, Artificial Sequence; identical to SEQ ID NO: 64339
  derived and/or modified sequence opt1 from hemagglutinin__InfluenzaA__ACZ16820

SEQ ID NO: 64709 - RNA, 1701 nt, Artificial Sequence; identical to SEQ ID NO: 63664
  derived and/or modified sequence opt1 from hemagglutinin__InfluenzaA__ACZ16830

SEQ ID NO: 64710 - RNA, 1701 nt, Artificial Sequence
  derived and/or modified sequence opt1 from hemagglutinin__InfluenzaA__ACZ16840
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcacgaagguccgggaccaggagggccgcaugaacuacuacuggacccugguggagccgggggacaagaucaccuucgaggcgaccggcaaccucguggucccccgguacgccuucgccauggagcgcaacgccgggagcggcaucaucaucuccgacacgcccgugcacgacugcaacacgaccugccagacccccaagggcgccaucaacaccagccugccguuccagaacauccaccccaucaccaucgggaagugccccaaguacgugaaguccaccaagcugcggcucgcgaccggccugcgcaacguccccagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64711 - RNA, 1701 nt, Artificial Sequence; identical to SEQ ID NO: 63664
  derived and/or modified sequence opt1 from hemagglutinin__InfluenzaA__ACZ16850

SEQ ID NO: 64712 - RNA, 1701 nt, Artificial Sequence
  derived and/or modified sequence opt1 from hemagglutinin__InfluenzaA__ACZ16860
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggcgccccgguacgccuucgccauggagcgcaacgccgggagcggcaucaucaucuccgacacccccguccacgacugcaacacgaccugccagaccccgaagggcgccaucaacaccagccugcccuuccagaacauccaccccaucacgaucgggaagugccccaaguacgugaaguccaccaagcugcggcucgccaccggccugcgcaacgugccgagcauccagucccgggggcuguucggcgccaucgccggguucaucgagggcggcuggaccgggauggucgacggcugguacggguaccaccaccagaacgagcagggcagcggguacgccgcggaccucaaguccacgcagaacgccaucgacgagaucaccaacaaggugaacagcgugaucgagaagaugaacacccaguucaccgccgucggcaaggaguucaaccaccuggagaagcgcaucgagaaccugaacaagaagguggacgacggcuuccucgacaucuggacguacaacgccgagcugcugguccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggcgaagcugaaccgggaggagaucgacggcgugaagcucgaguccacccgcaucuaccagauccuggccaucuacagcaccguggccagcucccugguccucguggugagccugggggccaucuccuucuggaugugcagcaacggcucccugcagugccggaucugcaucuga

SEQ ID NO: 64713 - RNA, 1701 nt, Artificial Sequence; identical to SEQ ID NO: 64407
  derived and/or modified sequence opt1 from hemagglutinin__InfluenzaA__ACZ16870

SEQ ID NO: 64714 - RNA, 1701 nt, Artificial Sequence
  derived and/or modified sequence opt1 from hemagglutinin__InfluenzaA__ACZ16880
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgacgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcggcucgccaccggccugcgcaacgucccgagcauccagucccgggggcuguucggcgcgaucgccggguucaucgagggcggcuggaccgggaugguggacggcugguacggguaccaccaccagaacgagcagggcagcggguacgccgccgaccucaaguccacgcagaacgccaucgacgagaucaccaacaaggugaacagcgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcaacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcgagcucccuggugcucguggucagccugggggccaucuccuucuggaugugcagcaacggcucccugcagugccggaucugcaucuga

SEQ ID NO: 64715 - RNA, 1701 nt, Artificial Sequence; identical to SEQ ID NO: 64412
  derived and/or modified sequence opt1 from hemagglutinin__InfluenzaA__ACZ16890

SEQ ID NO: 64716 - RNA, 1701 nt, Artificial Sequence; identical to SEQ ID NO: 63664
  derived and/or modified sequence opt1 from hemagglutinin__InfluenzaA__ACZ16900

SEQ ID NO: 64717 - RNA, 1701 nt, Artificial Sequence; identical to SEQ ID NO: 63664
  derived and/or modified sequence opt1 from hemagglutinin__InfluenzaA__ACZ16910

SEQ ID NO: 64718 - RNA, 1701 nt, Artificial Sequence; identical to SEQ ID NO: 63664
  derived and/or modified sequence opt1 from hemagglutinin__InfluenzaA__ACZ16920

SEQ ID NO: 64719 - RNA, 1701 nt, Artificial Sequence; identical to SEQ ID NO: 63677
  derived and/or modified sequence opt1 from hemagglutinin__InfluenzaA__ACZ16930

SEQ ID NO: 64720 - RNA, 1701 nt, Artificial Sequence; identical to SEQ ID NO: 63677
  derived and/or modified sequence opt1 from hemagglutinin__InfluenzaA__ACZ16940

SEQ ID NO: 64721 - RNA, 1701 nt, Artificial Sequence; identical to SEQ ID NO: 63664
  derived and/or modified sequence opt1 from hemagglutinin__InfluenzaA__ACZ16950

SEQ ID NO: 64722 - RNA, 1701 nt, Artificial Sequence; identical to SEQ ID NO: 63919
  derived and/or modified sequence opt1 from hemagglutinin__InfluenzaA__ACZ16960

SEQ ID NO: 64723 - RNA, 1701 nt, Artificial Sequence
  derived and/or modified sequence opt1 from hemagglutinin__InfluenzaA__ACZ16970
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaaggaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64724 - RNA, 1701 nt, Artificial Sequence; identical to SEQ ID NO: 63677
  derived and/or modified sequence opt1 from hemagglutinin__InfluenzaA__ACZ16980

SEQ ID NO: 64725 - RNA, 1701 nt, Artificial Sequence; identical to SEQ ID NO: 63677
  derived and/or modified sequence opt1 from hemagglutinin__InfluenzaA__ACZ17000

SEQ ID NO: 64726 - RNA, 1701 nt, Artificial Sequence
  derived and/or modified sequence opt1 from hemagglutinin__InfluenzaA__ACZ17010
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagcaaguacuccaagaaguucaagcccgagaucgccauccggccgaagguccgcgaccaggagggccggaugaacuacuacuggacgcugguggagcccggggacaagaucaccuucgaggcgaccggcaaccucguggucccccgcuacgccuucgccauggagcggaacgccgggagcggcaucaucaucuccgacacccccgugcacgacugcaacacgaccugccagaccccgaagggcgccaucaacaccagccugcccuuccagaacauccaccccaucacgaucgggaagugccccaaguacgugaaguccaccaagcugcgccucgcgaccggccugcggaacgucccgagcauccagucccgcgggcuguucggcgccaucgccggguucaucgagggcggcuggaccgggaugguggacggcugguacggguaccaccaccagaacgagcagggcagcggguacgccgccgaccucaaguccacgcagaacgcgaucgacaagaucaccaacaaggugaacagcgucaucgagaagaugaacacccaguucaccgccgugggcaaggaguucaaccaccuggagaagcggaucgagaaccugaacaagaaggucgacgacggcuuccucgacaucuggacguacaacgccgagcugcuggugcuccuggagaacgagcgcacccuggacuaccacgacuccaacgugaagaaccucuacgagaagguccggagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgcgaggagaucgacggcgugaagcucgaguccacccggaucuaccagauccuggcgaucuacagcaccgucgccagcucccuggugcucguggucagccugggggccaucuccuucuggaugugcagcaacggcucccugcagugccgcaucugcaucuga

SEQ ID NO: 64727 - RNA, 1701 nt, Artificial Sequence; identical to SEQ ID NO: 63677
  derived and/or modified sequence opt1 from hemagglutinin__InfluenzaA__ACZ17020

SEQ ID NO: 64728 - RNA, 1701 nt, Artificial Sequence
  derived and/or modified sequence opt1 from hemagglutinin__InfluenzaA__ACZ17030
augaaggccacccuggugguccuccuguacaccuucgccacggcgaacgccgacacccugugcaucggcuaccacgccaacaacagcaccgacaccguggacacggugcucgagaagaacgucaccgugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggaggccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgcgggcgccaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgcgauccgcccgaagguccgggaccaggagggccgcaugaacuacuacuggacccugguggagcccggggacaagaucaccuucgaggccaccggcaaccucguggucccccgguacgccuucgccauggagcgcaacgccggguccggcaucaucaucagcgacacgcccgugcacgacugcaacacgaccugccagaccccgaagggcgcgaucaacaccucccugcccuuccagaacauccaccccaucaccaucgggaagugccccaaguacgucaagagcaccaagcugcggcucgccaccggccugcgcaacgugccguccauccagagccgggggcuguucggcgccaucgccggguucaucgagggcggcuggacggggaugguggacggcugguacggguaccaccaccagaacgagcagggcuccggguacgccgcggaccucaagagcacccagaacgccaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 64729 - RNA, 1701 nt, Artificial Sequence
  derived and/or modified sequence opt1 from hemagglutinin__InfluenzaA__ACZ17040
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccaaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64730 - RNA, 1701 nt, Artificial Sequence; identical to SEQ ID NO: 63677
  derived and/or modified sequence opt1 from hemagglutinin__InfluenzaA__ACZ17050

SEQ ID NO: 64731 - RNA, 1701 nt, Artificial Sequence; identical to SEQ ID NO: 63677
  derived and/or modified sequence opt1 from hemagglutinin__InfluenzaA__ACZ17060

SEQ ID NO: 64732 - RNA, 1701 nt, Artificial Sequence; identical to SEQ ID NO: 63677
  derived and/or modified sequence opt1 from hemagglutinin__InfluenzaA__ACZ17070

SEQ ID NO: 64733 - RNA, 1701 nt, Artificial Sequence; identical to SEQ ID NO: 63857
  derived and/or modified sequence opt1 from hemagglutinin__InfluenzaA__ACZ17080

SEQ ID NO: 64734 - RNA, 1701 nt, Artificial Sequence
  derived and/or modified sequence opt1 from hemagglutinin__InfluenzaA__ACZ17090
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcugggggacaagcacaacggcaagcucugcaagcugcgcggggucgcgccccugcaccucggcaagugcaacaucgccggguggauccugggcaacccggagugcgagagccuguccaccgccagcuccuggagcuacaucguggagaccuccagcuccgacaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaaggucaagucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgcgaggagaucgacggggugaagcucgagagcacccggaucuaccagauccuggcgaucuacuccaccgucgccagcagccuggugcucguggucucccugggcgccaucagcuucuggaugugcuccaacggcagccugcagugccgcaucugcaucuga

SEQ ID NO: 64735 - RNA, 1701 nt, Artificial Sequence; identical to SEQ ID NO: 63664
  derived and/or modified sequence opt1 from hemagglutinin__InfluenzaA__ACZ17100

SEQ ID NO: 64736 - RNA, 1701 nt, Artificial Sequence
  derived and/or modified sequence opt1 from hemagglutinin__InfluenzaA__ACZ17110
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccgagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64737 - RNA, 1701 nt, Artificial Sequence
  derived and/or modified sequence opt1 from hemagglutinin__InfluenzaA__ACZ17120
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaccaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64738 - RNA, 1701 nt, Artificial Sequence
  derived and/or modified sequence opt1 from hemagglutinin__InfluenzaA__ACZ17130
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacgcccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggcgaagcugaaccgggaggagaucgacggcgugaagcucgagagcacccgcaucuaccagauccuggccaucuacuccaccgucgccagcagccuggugcucguggucucccugggggccaucagcuucuggaugugcuccaacggcagccugcagugccggaucugcaucuga

SEQ ID NO: 64739 - RNA, 1701 nt, Artificial Sequence; identical to SEQ ID NO: 64475
  derived and/or modified sequence opt1 from hemagglutinin__InfluenzaA__ACZ17140

SEQ ID NO: 64740 - RNA, 1701 nt, Artificial Sequence; identical to SEQ ID NO: 64306
  derived and/or modified sequence opt1 from hemagglutinin__InfluenzaA__ACZ17150

SEQ ID NO: 64741 - RNA, 1701 nt, Artificial Sequence; identical to SEQ ID NO: 64306
  derived and/or modified sequence opt1 from hemagglutinin__InfluenzaA__ACZ17160

SEQ ID NO: 64742 - RNA, 1701 nt, Artificial Sequence; identical to SEQ ID NO: 64306
  derived and/or modified sequence opt1 from hemagglutinin__InfluenzaA__ACZ17170

SEQ ID NO: 64743 - RNA, 1701 nt, Artificial Sequence
  derived and/or modified sequence opt1 from hemagglutinin__InfluenzaA__ACZ17190
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcuccacgaccugccagaccccggagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64744 - RNA, 1701 nt, Artificial Sequence; identical to SEQ ID NO: 64743
  derived and/or modified sequence opt1 from hemagglutinin__InfluenzaA__ACZ17200

SEQ ID NO: 64745 - RNA, 1701 nt, Artificial Sequence; identical to SEQ ID NO: 63677
  derived and/or modified sequence opt1 from hemagglutinin__InfluenzaA__ACZ17220

SEQ ID NO: 64746 - RNA, 1701 nt, Artificial Sequence
  derived and/or modified sequence opt1 from hemagglutinin__InfluenzaA__ACZ17230
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcucaaggagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaaccucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccggaucuaccagauccuggcgaucuacuccaccgucgccagcagccuggugcucguggucucccugggggccaucagcuucuggaugugcuccaacggcagccugcagugccgcaucugcaucuga

SEQ ID NO: 64747 - RNA, 1701 nt, Artificial Sequence; identical to SEQ ID NO: 63677
  derived and/or modified sequence opt1 from hemagglutinin__InfluenzaA__ACZ17240

SEQ ID NO: 64748 - RNA, 1701 nt, Artificial Sequence; identical to SEQ ID NO: 63677
  derived and/or modified sequence opt1 from hemagglutinin__InfluenzaA__ACZ17250

SEQ ID NO: 64749 - RNA, 1701 nt, Artificial Sequence; identical to SEQ ID NO: 63677
  derived and/or modified sequence opt1 from hemagglutinin__InfluenzaA__ACZ17260

SEQ ID NO: 64750 - RNA, 1701 nt, Artificial Sequence
  derived and/or modified sequence opt1 from hemagglutinin__InfluenzaA__ACZ17270
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggcggugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgcgagcagcugagcuccgugagcuccuucgagcgguucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgcuacagcaagaaguucaagcccgagaucgccauccggccgaagguccgcgaccaggagggccggaugaacuacuacuggacccugguggagcccggggacaagaucaccuucgaggcgaccggcaaccucguggucccccgcuacgccuucgccauggagcggaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcgccucgcgaccggccugcggaacgugccguccauccagagccgcgggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgucaucgagaagaugaacacccaguucacggccgugggcaaggaguucaaccaccuggagaagcggaucgagaaccugaacaagaaggucgacgacggcuuccucgacaucuggaccuacaacgccgagcugcuggugcuccuggagaacgagcgcacccuggacuaccacgacagcaacgugaagaagcucuacgagaagguccggucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgcgaggagaucgacggcgugaagcucgagagcacccgggucuaccagauccuggcgaucuacuccaccguggccagcagccuggugcucgucgugucccugggggccaucagcuucuggaugugcuccaacggcagccugcagugccgcaucugcaucuga

SEQ ID NO: 64751 - RNA, 1701 nt, Artificial Sequence; identical to SEQ ID NO: 63857
  derived and/or modified sequence opt1 from hemagglutinin__InfluenzaA__ACZ17290

SEQ ID NO: 64752 - RNA, 1701 nt, Artificial Sequence; identical to SEQ ID NO: 63857
  derived and/or modified sequence opt1 from hemagglutinin__InfluenzaA__ACZ17300

SEQ ID NO: 64753 - RNA, 1701 nt, Artificial Sequence; identical to SEQ ID NO: 63857
  derived and/or modified sequence opt1 from hemagglutinin__InfluenzaA__ACZ17310

SEQ ID NO: 64754 - RNA, 1701 nt, Artificial Sequence; identical to SEQ ID NO: 63677
  derived and/or modified sequence opt1 from hemagglutinin__InfluenzaA__ACZ17398

SEQ ID NO: 64755 - RNA, 1701 nt, Artificial Sequence; identical to SEQ ID NO: 63677
  derived and/or modified sequence opt1 from hemagglutinin__InfluenzaA__ACZ17408

SEQ ID NO: 64756 - RNA, 1701 nt, Artificial Sequence; identical to SEQ ID NO: 63677
  derived and/or modified sequence opt1 from hemagglutinin__InfluenzaA__ACZ17418

SEQ ID NO: 64757 - RNA, 1701 nt, Artificial Sequence
  derived and/or modified sequence opt1 from hemagglutinin__InfluenzaA__ACZ17438
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacuccuacguguucgugggcagcucccgguacagcaagaaguucaagcccgagaucgccauccgcccgaagguccgggaccaggagggccgcaugaacuacuacuggacgcugguggagcccggggacaagaucaccuucgaggccaccggcaaccucguggucccccgguacgcguucgccauggagcgcaacgccggguccggcaucaucaucagcgacacccccgugcacgacugcaacacgaccugccagaccccgaagggcgccaucaacaccucccugcccuuccagaacauccaccccaucacgaucgggaagugccccaaguacgucaagagcaccaagcugcggcucgccaccggccugcgcaacgugccguccauccagagccgggggcuguucggcgcgaucgccggguucaucgagggcggcuggaccgggaugguggacggcugguacggguaccaccaccagaacgagcagggcuccggguacgccgccgaccucaagagcacgcagaacgccaucgacgagaucaccaacaaggugaacuccgucaucgagaagaugaacacccaguucaccgcggugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggccaucuacagcaccgucgcguccagccuggugcucguggucucccugggggccaucagcuucuggaugugcuccaacggcagccugcagugccggaucugcaucuga

SEQ ID NO: 64758 - RNA, 1701 nt, Artificial Sequence; identical to SEQ ID NO: 63664
  derived and/or modified sequence opt1 from hemagglutinin__InfluenzaA__ACZ17448

SEQ ID NO: 64759 - RNA, 1701 nt, Artificial Sequence; identical to SEQ ID NO: 63677
  derived and/or modified sequence opt1 from hemagglutinin__InfluenzaA__ACZ17458

SEQ ID NO: 64760 - RNA, 1701 nt, Artificial Sequence; identical to SEQ ID NO: 63664
  derived and/or modified sequence opt1 from hemagglutinin__InfluenzaA__ACZ17478

SEQ ID NO: 64761 - RNA, 1701 nt, Artificial Sequence; identical to SEQ ID NO: 63677
  derived and/or modified sequence opt1 from hemagglutinin__InfluenzaA__ACZ17488

SEQ ID NO: 64762 - RNA, 1701 nt, Artificial Sequence
  derived and/or modified sequence opt1 from hemagglutinin__InfluenzaA__ACZ18240
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccaccagcuccuggagcuacaucguggagacguccagcuccgacaacgggaccugcuaccccggcgacuucaucgacuacgaggagcuccgggagcagcugagcuccgugagcuccuucgagcgcuucgagaucuuccccaagaccagcuccuggcccaaccacgacccgaacaagggcgucaccgccgccugcccccacgccggcgccaagagcuucuacaagaaccugaucuggcucgugaagaaggggaacuccuaccccaagcugagcaaguccuacaucaacgacaagggcaaggaggugcugguccucugggggauccaccaccccagcacgagcgcggaccagcagucccuguaccagaacgccgacgccuacguguucgugggcaccagccgguacuccaagaaguucaagccggagaucgccauccgccccaagguccgggaccaggagggccgcaugaacuacuacuggacccugguggagcccggggacaagaucaccuucgaggccacgggcaaccucguggucccccgguacgcguucgccauggagcgcaacgccgggagcggcaucaucaucuccgacaccccggugcacgacugcaacacgaccugccagacccccaagggcgccaucaacaccagccugcccuuccagaacauccaccccaucaccaucgggaagugcccgaaguacgugaaguccaccaagcugcggcucgccacgggccugcgcaacguccccagcauccagucccgggggcuguucggcgcgaucgccggguucaucgagggcggcuggaccgggaugguggacggcugguacggguaccaccaccagaacgagcagggcagcggguacgccgccgaccucaaguccacccagaacgccaucgacgagaucaccaacaaggugaacagcgucaucgagaagaugaacacgcaguucaccgcggugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggccaucuacagcaccgucgcguccagccuggugcucguggucagccugggggccaucuccuucuggaugugcagcaacggcucccugcagugccggaucugcaucuga

SEQ ID NO: 64763 - RNA, 1701 nt, Artificial Sequence; identical to SEQ ID NO: 63677
  derived and/or modified sequence opt1 from hemagglutinin__InfluenzaA__ACZ18241

SEQ ID NO: 64764 - RNA, 1701 nt, Artificial Sequence
  derived and/or modified sequence opt1 from hemagglutinin__InfluenzaA__ACZ27800
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaaggaguucaagcccgagaucgccauccgcccgaagguccggggccaggaggggcgcaugaacuacuacuggacgcugguggagcccggcgacaagaucaccuucgaggcgaccgggaaccucguggucccccgguacgccuucgccauggagcgcaacgccggcagcggcaucaucaucuccgacacccccgugcacgacugcaacacgaccugccagaccccgaagggggccaucaacaccagccugcccuuccagaacauccaccccaucacgaucggcaagugccccaaguacgugaaguccaccaagcugcggcucgcgaccgggcugcgcaacgucccgagcauccagucccggggccuguucggggccaucgccggcuucaucgagggcggguggaccggcaugguggacgggugguacggcuaccaccaccagaacgagcaggggagcggcuacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggguuccucgacaucuggacguacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuaccccaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacggcucccugcagugccggaucugcaucuga

SEQ ID NO: 64765 - RNA, 1701 nt, Artificial Sequence; identical to SEQ ID NO: 63677
  derived and/or modified sequence opt1 from hemagglutinin__InfluenzaA__ACZ27810

SEQ ID NO: 64766 - RNA, 1701 nt, Artificial Sequence; identical to SEQ ID NO: 63677
  derived and/or modified sequence opt1 from hemagglutinin__InfluenzaA__ACZ27820

SEQ ID NO: 64767 - RNA, 1701 nt, Artificial Sequence; identical to SEQ ID NO: 63677
  derived and/or modified sequence opt1 from hemagglutinin__InfluenzaA__ACZ27830

SEQ ID NO: 64768 - RNA, 1701 nt, Artificial Sequence; identical to SEQ ID NO: 64030
  derived and/or modified sequence opt1 from hemagglutinin__InfluenzaA__ACZ27840

SEQ ID NO: 64769 - RNA, 1701 nt, Artificial Sequence; identical to SEQ ID NO: 63664
  derived and/or modified sequence opt1 from hemagglutinin__InfluenzaA__ACZ45006

SEQ ID NO: 64770 - RNA, 1701 nt, Artificial Sequence
  derived and/or modified sequence opt1 from hemagglutinin__InfluenzaA__ACZ45007
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacgugccguccauccagagccgggggcuguucggcgccaucgccggguucaucgagggcggcuggacggggaugguggacggcugguacggguaccaccaccagaacgagcagggcuccggggacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacagcaacgugaagaaccucuacgagaagguccgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgugaagcucgagagcacccgcaucuaccagauccuggcgaucuacuccaccgucgccagcagccuggugcucguggucucccugggggccaucagcuucuggaugugcuccaacggcagccugcagugccggaucugcaucuga

SEQ ID NO: 64771 - RNA, 1701 nt, Artificial Sequence; identical to SEQ ID NO: 64030
  derived and/or modified sequence opt1 from hemagglutinin__InfluenzaA__ACZ45008

SEQ ID NO: 64772 - RNA, 1701 nt, Artificial Sequence; identical to SEQ ID NO: 64030
  derived and/or modified sequence opt1 from hemagglutinin__InfluenzaA__ACZ45009

SEQ ID NO: 64773 - RNA, 1701 nt, Artificial Sequence; identical to SEQ ID NO: 63919
  derived and/or modified sequence opt1 from hemagglutinin__InfluenzaA__ACZ45010

SEQ ID NO: 64774 - RNA, 1701 nt, Artificial Sequence; identical to SEQ ID NO: 63677
  derived and/or modified sequence opt1 from hemagglutinin__InfluenzaA__ACZ45012

SEQ ID NO: 64775 - RNA, 1701 nt, Artificial Sequence
  derived and/or modified sequence opt1 from hemagglutinin__InfluenzaA__ACZ45013
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcuccaagggggucaccgccgccugcccgcacgccggcgccaagagcuucuacaagaaccugaucuggcucgugaagaaggggaacuccuaccccaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucgccauggagcgcaacgccgggagcggcaucaucaucuccgacacgcccgugcacgacugcaacacgaccugccagaccccgaagggcgccaucaacaccagccugcccuuccagaacauccaccccaucaccaucgggaagugccccaaguacgugaaguccaccaagcugcggcucgcgaccggccugcgcaacgucccgagcauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggcuuccucgacaucuggaccuacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64776 - RNA, 1701 nt, Artificial Sequence; identical to SEQ ID NO: 63677
  derived and/or modified sequence opt1 from hemagglutinin__InfluenzaA__ACZ45014

SEQ ID NO: 64777 - RNA, 1701 nt, Artificial Sequence; identical to SEQ ID NO: 63677
  derived and/or modified sequence opt1 from hemagglutinin__InfluenzaA__ACZ45016

SEQ ID NO: 64778 - RNA, 1701 nt, Artificial Sequence
  derived and/or modified sequence opt1 from hemagglutinin__InfluenzaA__ACZ45028
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacauccaccccaucaccaucgggaagugccccaaguacgucaagagcaccaagcugcggcucgcgaccggccugcgcaacaucccguccauccagagccgggggcuguucggcgccaucgccggguucaucgagggcggcuggacggggaugguggacggcugguacggguaccaccaccagaacgagcagggcuccggguacgccgccgaccucaagagcacccagaacgcgaucgacgagaucaccaacaaggugaacuccgugaucgagaagaugaacacccaguucacggccgucggcaaggaguucaaccaccuggagaagcgcaucgagaaccugaacaagaagguggacgacggcuuccucgacaucuggaccuacaacgccgagcugcugguccuccuggagaacgagcggacccuggacuaccacgacagcaacgugaagaaccucuacgagaaggugcgcucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgggaggagaucgacggcgugaagcucgagagcacccgcaucuaccagauccuggcgaucuacuccaccguggccagcagccugguccucguggugucccugggggccaucagcuucuggaugugcuccaacggcagccugcagugccggaucugcaucuga

SEQ ID NO: 64779 - RNA, 1701 nt, Artificial Sequence
  derived and/or modified sequence opt1 from hemagglutinin__InfluenzaA__ACZ45029
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccggcaacggcacgugcuaccccggggacuucaucgacuacgaggagcuccgggagcagcugagcuccgugagcuccuucgagcgcuucgagaucuuccccaagaccagcuccuggcccaaccacgacagcaacaagggcgucaccgccgccugcccgcacgccggggcgaaguccuucuacaagaaccugaucuggcucgugaagaagggcaacagcuaccccaagcuguccaagagcuacaucaacgacaaggggaaggaggugcugguccucuggggcauccaccaccccagcaccuccgccgaccagcagagccuguaccagaacgccgacgccuacguguucgugggcacgucccgguacagcaagaaguucaagcccgagaucgccauccgcccgaagguccgggaccaggaggggcgcaugaacuacuacuggacccugguggagcccggcgacaagaucaccuucgaggcgaccgggaaccucguggucccccgguacgccuucgccauggagcgcaacgccggcuccggcaucaucaucagcgacacgcccgugcacgacugcaacacgaccugccagaccccgaagggggccaucaacaccucccugcccuuccagaacauccaccccaucaccaucggcaagugccccaaguacgucaagagcaccaagcugcggcucgcgaccgggcugcgcaacgugccguccauccagagccggggccuguucggggccaucgccggcuucaucgagggcggguggacgggcaugguggacgggugguacggcuaccaccaccagaacgagcagggguccggcuacgccgccgaccucaagagcacccagaacgcgaucgacgagaucaccaacaaggugaacuccgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacagcaacgugaagaaccucuacgagaagguccgcucccagcugaagaacaacgccaaggagaucggcaacgggugcuucgaguucuaccacaagugcgacaacacgugcauggagagcgugaagaacggcaccuacgacuaccccaaguacuccgaggaggccaagcugaaccgggaggagaucgacggggugaagcucgagagcacccgcaucuaccagauccuggcgaucuacuccaccgucgccagcagccuggugcucguggucucccugggcgccaucagcuucuggaugugcuccaacggcagccugcagugccggaucugcaucuga

SEQ ID NO: 64780 - RNA, 1701 nt, Artificial Sequence
  derived and/or modified sequence opt1 from hemagglutinin__InfluenzaA__ACZ45030
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacguccaccuacagcaagaaguucaagcccgagaucgccauccggccgaagguccgcgaccaggagggccggaugaacuacuacuggacccugguggagcccggggacaagaucaccuucgaggcgacgggcaaccucguggucccccgcuacgccuucaccauggagcggaacgccggguccggcaucaucaucagcgacacccccgugcacgacugcaacaccacgugccagaccccgaagggcgccaucaacaccucccugcccuuccagaacauccaccccaucaccaucgggaagugccccaaguacgucaagagcacgaagcugcgccucgccaccggccugcggaacaucccguccauccagagccgcgggcuguucggcgcgaucgccggguucaucgagggcggcuggaccgggaugguggacggcugguacggguaccaccaccagaacgagcagggcuccggguacgccgccgaccucaagagcacccagaacgccaucgacgagaucacgaacaaggugaacuccgugaucgagaagaugaacacccaguucaccgcggucggcaaggaguucaaccaccuggagaagcggaucgagaaccugaacaagaagguggacgacggcuuccucgacaucuggaccuacaacgccgagcugcugguccuccuggagaacgagcgcacgcuggacuaccacgacagcaacgugaagaaccucuacgagaaggugcggucccagcugaagaacaacgccaaggagaucgggaacggcugcuucgaguucuaccacaagugcgacaacacgugcauggagagcgucaagaacgggaccuacgacuaccccaaguacuccgaggaggccaagcugaaccgcgaggagaucgacggcgugaagcucgagagcacccggaucuaccagauccuggccaucuacuccaccguggcgagcagccugguccucguggugucccugggggccaucagcuucuggaugugcuccaacggcagccugcagugccgcaucugcaucuga

SEQ ID NO: 64781 - RNA, 1701 nt, Artificial Sequence
  derived and/or modified sequence opt1 from hemagglutinin__InfluenzaA__ACZ45031
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggagcaggagggccgcaugaacuacuacuggacccugguggagcccggggacaagaucaccuucgaggcgaccggcaaccucguggucccccgguacgccuucacgauggagcgcaacgugggguccggcaucaucaucagcgacacccccgugcacgacugcaacacgaccugccagaccccgaagggcgccaucaacaccucccugcccuuccagaacauccaccccaucaccaucgggaagugccccaaguacgucaagagcaccaagcugcggcucgccacgggccugcgcaacgugccguccauccagagccgggggcuguucggcgccaucgcgggguucaucgagggcggcuggaccgggaugguggacggcugguacggguaccaccaccagaacgagcagggcuccggguacgccgccgaccucaagagcacccagaacgccaucgacgagaucaccaacaaggucaacuccgugaucgagaagaugaacacgcaguucaccgccgucggcaaggaguucaaccaccuggagaagcgcaucgagaaccugaacaagaagguggacgacggcuuccucgacaucuggaccuacaacgcggagcugcuggugcuccuggagaacgagcggacccuggacuaccacgacagcaacgucaagaaccucuacgagaaggugcgcucccagcugaagaacaacgccaaggagaucgggaacggcugcuucgaguucuaccacaagugcgacaacacgugcauggagagcgugaagaacgggaccuacgacuaccccaaguacuccgaggaggccaagcugaaccgggaggagaucgacggcgucaagcucgagagcacccgcaucuaccagauccuggccaucuacuccaccguggccagcagccuggugcucgucgugucccugggggcgaucagcuucuggaugugcuccaacggcagccugcagugccggaucugcaucuga

SEQ ID NO: 64782 - RNA, 1701 nt, Artificial Sequence
  derived and/or modified sequence opt1 from hemagglutinin__InfluenzaA__ACZ45034
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcacgucccgguacagcaagaaguucaagcccgagaucgccauccgcccgaagguccgggaccaggagggccgcaugaacuacuacuggacccugguggagcccggggacaagaucaccuucgaggcgaccggcaaccucguggucccccgguacgccuucgccauggagcgcaacgccggguccggcaucaucaucagcgacacgcccgugcacgacugcaacacgaccugccagaccccgaagggcgccaucaacaccucccugcccuuccagaacgugcaccccaucaccaucgggaagugccccaaguacgucaagagcaccaagcugcggcucgcgaccggccugcgcaacgugccgcccauccagucccgggggcuguucggcgccaucgccggguucaucgagggcggcuggacggggaugguggacggcugguacggguaccaccaccagaacgagcagggcagcggguacgccgccgaccucaaguccacccagaacgcgaucgacgagaucaccaacaaggucaacagcgugaucgagaagaugaacacccaguucacggccgucggcaaggaguucaaccaccuggagaagcgcaucgagaaccugaacaagaagguggacgacggcuuccucgacaucuggaccuacaacgccgagcugcuggugcuccuggagaacgagcggacccuggacuaccacgacuccaacgucaagaaccucuacgagaaggugcgcagccagcugaagaacaacgccaaggagaucgggaacggcugcuucgaguucuaccacaagugcgacaacacgugcauggaguccgugaagaacgggaccuacgacuaccccaaguacagcgaggaggccaagcugaaccgggaggagaucgacggcgucaagcucgaguccacccgcaucuaccagauccuggcgaucuacagcaccguggccuccagccuggugcucgucgugagccugggggccaucuccuucuggaugugcagcaacggcucccugcagugccggaucugcaucuga

SEQ ID NO: 64783 - RNA, 1701 nt, Artificial Sequence; identical to SEQ ID NO: 63677
  derived and/or modified sequence opt1 from hemagglutinin__InfluenzaA__ACZ45036

SEQ ID NO: 64784 - RNA, 1701 nt, Artificial Sequence; identical to SEQ ID NO: 63677
  derived and/or modified sequence opt1 from hemagglutinin__InfluenzaA__ACZ45037

SEQ ID NO: 64785 - RNA, 1701 nt, Artificial Sequence; identical to SEQ ID NO: 64778
  derived and/or modified sequence opt1 from hemagglutinin__InfluenzaA__ACZ45038

SEQ ID NO: 64786 - RNA, 1701 nt, Artificial Sequence; identical to SEQ ID NO: 64030
  derived and/or modified sequence opt1 from hemagglutinin__InfluenzaA__ACZ45039

SEQ ID NO: 64787 - RNA, 1701 nt, Artificial Sequence; identical to SEQ ID NO: 63677
  derived and/or modified sequence opt1 from hemagglutinin__InfluenzaA__ACZ45040

SEQ ID NO: 64788 - RNA, 1701 nt, Artificial Sequence; identical to SEQ ID NO: 63677
  derived and/or modified sequence opt1 from hemagglutinin__InfluenzaA__ACZ52567

SEQ ID NO: 64789 - RNA, 1701 nt, Artificial Sequence; identical to SEQ ID NO: 63677
  derived and/or modified sequence opt1 from hemagglutinin__InfluenzaA__ACZ52568

SEQ ID NO: 64790 - RNA, 1701 nt, Artificial Sequence; identical to SEQ ID NO: 64246
  derived and/or modified sequence opt1 from hemagglutinin__InfluenzaA__ACZ52569

SEQ ID NO: 64791 - RNA, 1701 nt, Artificial Sequence
  derived and/or modified sequence opt1 from hemagglutinin__InfluenzaA__ACZ53956
augaagaccaucaucgcccugagcuacaucuucugccucgcccuggcgcagaagcugcccggcaacgacaacuccaccgccacgcucugccuggggcaccacgccgugccgaacggcacccuggucaagaccaucaccaacgaccagaucgaggugacgaacgccaccgagcucgugcagagcuccagcaccgggcgcaucugcgacagcccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccagccuccgcucccugguggccagcuccggcacgcuggaguucaacaacgagagcuucaacuggaccggggucgcccagaacggcaccuccagcgcgugcaagcggcgcuccaucaagagcuucuucuccacccucaacuggcugcaccagcugcagaaccgguaccccgcccucaacgugacgaugcccaacaacgacaaguucgacaagcuguacaucuggggcgugcaccaccccagcaccgacuccgaccagaucagcgucuacgcccaggccagcgggcgcgugaccguguccaccaagcggagccagcagacggucaucccgaacaucgggucccgccccugggugcggggcgugagcucccgcaucagcaucuacuggaccaucgucaagcccggcgacauccugcucaucaacuccaccgggaaccugaucgcgccccggggcuacuucaagauccgcagcgggaaguccagcaucaugcgguccgacgccccgaucggcaagugcaacagcgagugcaucacccccaacggcuccauccccaacgacaagcccuuccagaacgugaaccgcaucacguacggggccugcccgcgguacgugaagcagaacacccugaagcucgccaccggcaugcgcaacguccccgagaagcagacccgggggaucuucggcgccaucgccggguucaucgagaacggcugggagggcaugauggacgggugguacggcuuccgccaccagaacagcgaggggacgggccaggcggccgaccugaaguccacccaggccgccaucaaccagaucaacgggaagcugaaccggcucaucgagaagaccaacgagaaguuccaccagaucgagaaggaguucagcgagguggagggccgcauccaggaccuggagaaguacguggaggacaccaagaucgaccugugguccuacaacgccgagcuccuggucgcgcuggagaaccagcacacgaucgaccucaccgacagcgagaugaacaagcuguucgagcggacccgcaagcagcugcgcgagaacgccgaggacaugggcaacgggugcuucaagaucuaccacaagugcgacaacgccugcaucggcuccauccggaacgggaccuacgaccacgacguguaccgcgacgaggcccucaacaaccgguuccagaucaagggcguggagcugaaguccggguacaaggacuggauccuguggaucagcuucgccaucuccugcuuccuccugugcgucgugcugcucggcuucaucaugugggcgugccagcgcggcaacauccggugcaacaucugcaucuga

SEQ ID NO: 64792 - RNA, 1701 nt, Artificial Sequence
  derived and/or modified sequence opt1 from hemagglutinin__InfluenzaA__ACZ53967
augaagaccaucaucgcccugagcuacaucuucugccucgcccuggcgcagaagcugcccggcaacgacaacuccaccgccacgcucugccuggggcaccacgccgugccgaacggcacccuggucaagaccaucaccaacgaccagaucgaggugacgaacgccaccgagcucgugcagagcuccagcaccgggcgcaucugcgacagcccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccagccuccgcucccugguggccagcuccggcacgcuggaguucaacaacgagagcuucaacuggaccggggucgcccagaacggcaccuccagcgcgugcaagcggcgcuccaucaagagcuucuucuccacccucaacuggcugcaccagcugcagaaccgguaccccgcccucaacgugacgaugcccaacaacgacaaguucgacaagcuguacaucuggggcgugcaccaccccagcaccgacuccgaccagaccagccuguacgcccaggccagcgggcgcgucaccguguccacgaagcggagccagcagaccgugaucccgaacaucgggucccgccccuggguccggggcgugagcucccgcaucagcaucuacuggaccaucgugaagcccggcgacguccucgugaucaacuccaacgggaaccugaucgcgccccggggcuacuucaagaugcgcagcgggaaguccagcaucaugcgguccgacgccccgaucggcaagugcaacagcgagugcaucacccccaacggcuccauccccaacgacaagcccuuccagaacgugaaccgcaucacguacggggccugcccgcgguacgucaagcagaacacccugaagcucgccaccggcaugcgcaacgugcccgagaagcagacccgggggaucuucggcgccaucgccggguucaucgagaacggcugggagggcaugauggacgggugguacggcuuccgccaccagaacagcgaggggacgggccaggcggccgaccugaaguccacccaggccgccaucaaccagaucaacgggaagcugaacaagcucaucgagaagaccaacgagaaguuccaccagaucgagaaggaguucagcgagguggagggccggauccaggaccuggagaaguacgucgaggacaccaagaucgaccugugguccuacaacgccgagcuccugguggcgcuggagaaccagcacacgaucgaccucaccgacagcgagaugaacaagcuguucgagcgcacccggaagcagcugcgcgagaacgccgaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucagcuucgccaucuccugcuuccuccugugcgugguccugcucggcagcaucaugugggcgugccagcggggcaacauccgcugcaacaucugcaucuga

SEQ ID NO: 64793 - RNA, 1701 nt, Artificial Sequence
  derived and/or modified sequence opt1 from hemagglutinin__InfluenzaA__ACZ53978
augaagaccaucaucgcccugagcuacaucuucugccucgcccuggcgcagaagcugcccggcaacgacaacuccaccgccacgcucugccuggggcaccacgccgugccgaacggcacccuggucaagaccaucaccaacgaccagaucgaggugacgaacgccaccgagcucgugcagagcuccagcaccgggcgcaucugcgacagcccccaccagauccuggacggcgagaacugcacccugaucgacgcccuccugggggacccccacugcgacggcuuccagaacaaggagugggaccuguucgucgagcggagcaaggcguacuccaacugcuaccccuacgacgugccggacuacgccagccucaagucccugaucgccagcuccggcacgcuggaguucaacaacgagagcuucaacuggaucggggugucccagaacggcaccagcuccgccugcaagcgcaucagcaucaccgucuccuucaacaagcucaacuggcugcaccagcugaaguaccgguaccccgcgcucaacgugaccaugcccaacaacgacaaguucgacaagcuguacaucuggggcgugcaccaccccagcacggacuccgaccagaccagccuguacgcccaggccagcgggcgcgucaccguguccaccaagcggagccagcagacggugaucccgaacaucgggucccgccccuggguccggggcgugagcucccgcaucagcaucuacuggaccaucgugaagcccggcgacguccucgugaucaacuccaacgggaaccugaucgcgccccggggcuacuucaagaugcgcagcgggaaguccagcaucaugcgguccgacgccccgaucggcaagugcaacagcgagugcaucacccccaacggcuccauccccaacgacaagcccuuccagaacgugaaccgcaucaccuacggggccugcccgcgguacgucaagcagaacacgcugaagcucgccaccggcaugcgcaacgugcccgagaagcagacccgggggaucuucggcgccaucgccggguucaucgagaacggcugggagggcaugguggacgggugguacggcuuccgccaccagaacagcgaggggaccggccaggccgcggaccugaaguccacgcaggccgccaucaaccagaucaccgggaagcugaacaagcucaucgagaagaccaacgagaaguuccaccagaucgagaaggaguucagcgaggucgagggccggauccaggaccuggagaaguacguggaggacaccaagaucgaccugugguccuacaacgccgagcuccugguggcccuggagaaccagcacacgaucgaccucaccgacagcgagaugaacaagcuguucgagcgcacccggaagcagcugcgcgagaacgcggaggacaugggcaacgggugcuucaagaucuaccacaagugcgacaacgccugcaucggcuccauccggaacgggaccuacgaccacgacgucuaccgcgacgaggcccucaacaaccgcuuccagaucaagggcguggagcugaaguccggguacaaggacuggauccuguggaucagcuucgccaucuccugcuuccuccugugcgucgugcugcucggcuucaucaugugggccugccagcggggcaacauccgcugcaacaucugcaucuga

SEQ ID NO: 64794 - RNA, 1701 nt, Artificial Sequence
  derived and/or modified sequence opt1 from hemagglutinin__InfluenzaA__ACZ56080
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgcgagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcucccacgccggcgccaagagcuucuacaagaaccugaucuggcucgugaagaaggggaacuccuacccgaagcugagcaagagcuacaucaacgacaagggcaaggaggugcugguccucugggggauccaccaccccuccaccagcgccgaccagcagucccuguaccagaacgccgacgccuacguguucgugggcacgagccgguacuccaagaaguucaagcccgagaucgccauccgccccaagguccggggccaggaggggcgcaugaacuacuacuggacccugguggagccgggcgacaagaucaccuucgaggcgaccgggaaccucguggucccccgguacgccuucgccauggagcgcaacgccggcagcggcaucaucaucuccgacacgcccgugcacgacugcaacacgaccugccagacccccaagggggccaucaacaccagccugccguuccagaacauccaccccaucaccaucggcaagugccccaaguacgugaaguccaccaagcugcggcucgcgaccgggcugcgcaacguccccagcauccagucccggggccuguucggggccaucgccggcuucaucgagggcggguggacgggcaugguggacgggugguacggcuaccaccaccagaacgagcaggggagcggcuacgccgccgaccucaaguccacccagaacgcgaucgacgagaucaccaacaaggugaacagcgucaucgagaagaugaacacccaguucacggccgugggcaaggaguucaaccaccuggagaagcgcaucgagaaccugaacaagaaggucgacgacggguuccucgacaucuggaccuacaacgccgagcugcuggugcuccuggagaacgagcggacccuggacuaccacgacuccaacgugaagaaccucuacgagaagguccgcagccagcugaagaacaacgccaaggagaucggcaacgggugcuucgaguucuaccacaagugcgacaacacgugcauggaguccgugaagaacggcaccuacgacuacccgaaguacagcgaggaggccaagcugaaccgggaggagaucgacggggugaagcucgaguccacccgcaucuaccagauccuggcgaucuacagcaccgucgccagcucccuggugcucguggucagccugggcgccaucuccuucuggaugugcagcaacggcucccugcagugccggaucugcaucuga

SEQ ID NO: 64795 - RNA, 1701 nt, Artificial Sequence
  derived and/or modified sequence opt1 from hemagglutinin__InfluenzaA__ACZ61118
augaaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccagagcaccuccgccgaccagcagagccuguaccagaacgccgacgccuacguguucgugggcuccagccgguacuccaagaaguucaagcccgagaucgccauccgccccaagguccgggaccaggagggccgcaugaacuacuacuggacgcugguggagccgggggacaagaucaccuucgaggcgaccggcaaccucguggucccccgguacgccuucgccauggagcgcaacgccgggagcggcaucaucaucuccgacacccccgugcacgacugcaacacgaccugccagacccccaagggcgccaucaacaccagccugccguuccagaacauccaccccaucacgaucgggaagugccccaaguacgugaaguccaccaagcugcggcucgcgaccggccugcgcaacguccccagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcuggugcuccuggagaacgagcggacccuggacuaccacgacuccaacgugaagaaccucuacgagaagguccgcagccagcugaagaacaacgccaaggagaucgggaacggcugcuucgaguucuaccacaagugcgacaacacgugcauggaguccgugaagaacgggaccuacgacuacccgaaguacagcgaggaggccaagcugaaccgggaggagaucgacggcgugaagcucgaguccacccgcaucuaccagauccuggcgaucuacagcaccgucgccagcucccuggugcucguggucagccugggggccaucuccuucuggaugugcagcaacggcucccugcagugccggaucugcaucuga

SEQ ID NO: 64796 - RNA, 1701 nt, Artificial Sequence
  derived and/or modified sequence opt1 from hemagglutinin__InfluenzaA__ACZ61119
auggaggccauccuggugguccuccuguacaccuucgccaccgcgaacgccgacacgcugugcaucggcuaccacgccaacaacagcaccgacaccguggacaccgugcucgagaagaacgucacggugacccacuccgugaaccugcuggaggacaagcacaacgggaagcucugcaagcugcgcggcgucgcgccccugcaccucgggaagugcaacaucgccggcuggauccuggggaacccggagugcgagagccuguccaccgccagcuccuggagcuacaucguggagaccuccagcuccgacaacggcacgugcuaccccggcgacuucaucgacuacgaggagcuccgggagcagcugagcuccgugagcuccuucgagcgcuucgagaucuuccccaagaccagcuccuggcccaaccacgacagcaacaagggggucaccgccgccugcccgcacgccggcgcgaaguccuucuacaagaaccugaucuggcucgugaagaaggggaacagcuaccccaagcuguccaagagcuacaucaacgacaagggcaaggaggugcugguccucugggggauccaccaccccagcaccuccgccgaccagcagagccuguaccagaacgccgacgccuacguguucgugggcuccagccgguacuccaagaaguucaagcccgagaucgccauccgcccgaagguccgggaccaggagggccgcaugaacuacuacuggacgcugguggagcccggggacaagaucaccuucgaggcgaccggcaaccucguggucccccgguacgccuucgccauggagcgcaacgccgggagcggcaucaucaucuccgacacccccgugcacgacugcaacacgaccugccagaccccgaagggcgccaucaacaccagccugcccuuccacaacauccaccccaucacgaucgggaagugccccaaguacgugaaguccaccaagcugcggcucgcgaccggccugcgcaacgucccgagcauccagucccgggggcuguucggcgccaucgccggguucaucgagggcggcuggaccgggaugguggacggcugguacggguaccaccaccagaacgagcagggcagcggguacgccgccgaccucaaguccacgcagaacgcgaucgacgagaucaccaacaaggugaacagcgucaucgagaagaugaacacccaguucaccgccgugggcaaggaguucaaccaccuggagaagcgcaucgagaaccugaacaagaaggucgacgacggcuuccucgacaucuggacguacaacgccgagcugcugauccuccuggagaacgagcggacccuggacuaccacgacuccaacgugaagaaccucuacgagaaggugcgcagccagcugaagaacaacgccaaggagaucgggaacggcugcuucgaguucuaccacaagugcgacaacacgugcauggaguccgucaagaacgggaccuacgacuaccccaaguacagcgaggaggccaagcugaaccgggaggagaucgacggcgugaagcucgaguccacccgcaucuaccagauccuggcgaucuacagcaccguggccagcucccugguccucguggugagccugggggccaucuccuucuggaugugcagcaacggcucccugcagugccggaucugcaucuga

SEQ ID NO: 64797 - RNA, 1701 nt, Artificial Sequence; identical to SEQ ID NO: 63677
  derived and/or modified sequence opt1 from hemagglutinin__InfluenzaA__ACZ61122

SEQ ID NO: 64798 - RNA, 1701 nt, Artificial Sequence; identical to SEQ ID NO: 63677
  derived and/or modified sequence opt1 from hemagglutinin__InfluenzaA__ACZ61123

SEQ ID NO: 64799 - RNA, 1701 nt, Artificial Sequence; identical to SEQ ID NO: 64475
  derived and/or modified sequence opt1 from hemagglutinin__InfluenzaA__ACZ74627

SEQ ID NO: 64800 - RNA, 1698 nt, Artificial Sequence
  derived and/or modified sequence opt1 from hemagglutinin__InfluenzaA__ACZ81554
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacaaccacaacgggaagcucugccugcugaagggcaucgcgccccuccagcuggggaacugcaccgucgccggcuggauccuggggaacccggagugcgagcuccugaucagcaaggaguccuggagcuacaucguggagaagcccaaccccgagaacggcacgugcuaccccggccacuucgccgacuacgaggagcugcgcgagcagcucuccagcguguccagcuucgagcgguucgagaucuucccgaaggaguccagcuggcccaaccacaccgucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucgccgaccagaagacgcuguaccacaccgagaacgccuacguguccgucgugagcucccacuacagccggaaguucacccccgagaucgccaagcgccccaagauccgggaccaggaggggcgcaucaacuacuacuggacccuccuggagcccggcgacacgaucaucuucgaggcgaacgggaaccugaucgccccgcgguacgccuucgcccucagccgcggcuucggguccggcaucaucaacagcaacgcccccauggacaagugcgacgcgaagugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgccggguucaucgagggcggcuggaccgggauggucgacggcugguacggguaccaccaccagaacgagcagggcagcggguacgcggccgaccagaaguccacccagaacgccaucaacggcaucaccaacaaggugaacagcgugaucgagaagaugaacacccaguucacggccgucggcaaggaguucaacaagcuggagcggcgcauggagaaccucaacaagaagguggacgacggguucaucgacaucuggaccuacaacgccgagcugcugguccuccuggagaacgagcggacccuggacuuccacgacuccaacgugaagaaccucuacgagaaggucaagagccagcugaagaacaacgcgaaggagaucggcaacgggugcuucgaguucuaccacaagugcaacgacgagugcauggaguccgugaagaacggcaccuacgacuaccccaaguacagcgaggaguccaagcugaaccgcgagaagaucgacggggugaagcucgagagcaugggcguguaccagauccuggccaucuacuccacggucgccagcucccuggugcuccuggugagccugggcgccaucagcuucuggaugugcuccaacgggagccuccagugccggaucugcaucuga

SEQ ID NO: 64801 - RNA, 1698 nt, Artificial Sequence
  derived and/or modified sequence opt1 from hemagglutinin__InfluenzaA__ACZ81555
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccgggguguccgccagcugcucccacaacggcgagaacagcuucuaccgcaaccugcuguggcucaccgggaagaacggccuguaccccaaccuguccaagagcuacgccaacaacaaggagaaggaggugcucguccuguggggcgugcaccacccgcccaacaucggcgaccagaagacccuguaccacacggagaacgccuacguguccgucgugagcagccacuacucccggaaguucacccccgagaucgccaagcgccccaaggugcgggaccaggagggccgcaucaacuacuacugggcccuccuggagcccggggacaccaucaucuucgaggcgaacggcaaccugaucgccccgcgguacgccuucgcccucagccgcggguucggcuccggcaucaucaacagcaacgcccccauggacaagugcgacgcgaagugccagacgccccagggggccaucaacuccagccugcccuuccagaacguccacccggugaccaucggcgagugccccaaguacgugcgguccgccaagcugcgcauggucaccgggcuccggaacauccccagcauccagucccgcggccuguucggggccaucgccggcuucaucgagggcggguggaccggcaugguggacgggugguacggcuaccaccaccagaacgagcaggggagcggcuacgcggccgaccagaaguccacccagaacgccaucaacggcaucacgaacaaggugaacagcgucaucgagaagaugaacacccaguucaccgccguggggaaggaguucaacaagcuggagcggcgcauggagaaccucaacaagaaggucgacgacggcuucaucgacaucuggaccuacaacgccgagcugcuggugcuccuggagaacgagcggacgcuggacuuccacgacuccaacgugaagaaccucuacgagaaggucaagagccagcugaagaacaacgcgaaggagaucgggaacggcugcuucgaguucuaccacaagugcaacgacgagugcauggaguccgugaagaacgggaccuacgacuaccccaaguacagcgaggaguccaagcugaaccgcgagaagaucgacggcgugaagcucgagagcaugggcgucuaccagauccuggccaucuacuccaccguggccagcagccuggugcuccuggucucccugggggccaucagcuucuggaugugcuccaacggcagccuccagugccggaucugcaucuga

SEQ ID NO: 64802 - RNA, 1698 nt, Artificial Sequence
  derived and/or modified sequence opt1 from hemagglutinin__InfluenzaA__ACZ81556
augaaggugaagcugcucguccugcugugcaccuucaccgccacguacgccgacaccaucugcaucggcuaccacgcgaacaacagcaccgacaccguggacacggugcucgagaagaacgucaccgugacccacuccgugaaccugcuggagaacagccacaacgggaagcucugccugcugaagggcaucgcgccccuccagcuggggaacugcuccgucgccggcuggauccuggggaacccggagugcgagcuccugaucagcaaggaguccuggagcuacaucguggagaagcccaaccccgagaacgggaccugcuaccccggccacuucgccgacuacgaggagcugcgcgagcagcucuccagcguguccagcuucgagcgguucgagaucuucccgaaggaguccagcuggcccaaccacacggucaccggggccuccgccagcugcucccacaacggcgagaacagcuucuaccgcaaccugcuguggcucaccgggaagaacggccuguaccccaaccuguccaagagcuacgccaacaacaaggagaaggaggugcucgugcuguggggcguccaccacccgcccaacaucgccgaccagaagacccuguaccacacggagaacgccuacguguccguggucagcagccacuacucccggaaguucacccccgagaucgcgaagcgccccaaggugcgggaccaggagggccgcaucaacuacuacuggacccuccuggagcccggcgacaccaucaucuucgaggccaacgggaaccugaucgccccgcgguacgccuucgcccucagccgcggcuucggguccggcaucaucaacagcaacgcgcccauggacaagugcgacgccaagugccagacgccccagggcgccaucaacuccagccugcccuuccagaacgugcacccggucaccaucggggagugccccaaguacgugcgguccgccaagcugcgcauggugaccggccuccggaacauccccagcauccagucccgcgggcuguucggcgccaucgcgggguucaucgagggcggcuggaccgggauggucgacggcugguacggguaccaccaccagaacgagcagggcagcggguacgccgccgaccagaaguccacgcagaacgccaucaacggcaucaccaacaaggugaacagcgugaucgagaagaugaacacccaguucaccgccgucggcaaggaguucaacaagcuggagcggcgcauggagaaccucaacaagaagguggacgacggguucaucgacaucuggacguacaacgcggagcugcugguccuccuggagaacgagcggacccuggacuuccacgacuccaacgugaagaaccucuacgagaaggucaagagccagcugaagaacaacgccaaggagaucggcaacgggugcuucgaguucuaccacaagugcaacgacgagugcauggaguccgugaagaacggcaccuacgacuaccccaaguacagcgaggaguccaagcugaacaaggagaagaucgacggggugaagcucgagagcaugggcguguaccagauccuggccaucuacuccaccgucgccagcagccuggugcuccuggugucccugggcgccaucagcuucuggaugugcuccaacgggagccuccagugccgcaucugcaucuga

SEQ ID NO: 64803 - RNA, 1701 nt, Artificial Sequence
  derived and/or modified sequence opt1 from hemagglutinin__InfluenzaA__ACZ81557
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcggcagcccccaccagauccucgacgggaagaacugcacccugaucgacgcccugcucggcgacccccagugcgacggcuuccagaacaagaagugggaccuguucguggagcgcagcaaggccuacuccaacugcuaccccuacgacgugccggacuacgcgagccugcggucccucgucgccagcuccgggacgcuggaguucaacaacgagagcuucaacuggaccggcgugacccagaacgggaccuccagcgccugcauccgccgguccaagaacagcuucuucucccgccugaacuggcucacgcaccugaacuucaaguaccaggcccugaacgugaccaugcccaacaacgagcaguucgacaagcucuacaucuggggcguccaccaccccgggaccgacaaggaccagaucuuccuguacgcgcaggccagcggccggaucaccguguccacgaagcgcagccagcagaccgugauccccaacaucggcagccggccgcgcguccggaacauccccucccgcaucagcaucuacuggaccaucgugaagcccggggacauccugcucaucaacuccaccggcaaccugaucgcgccccggggguacuucaagauccagagcggcaaguccagcaucaugcgcuccgacgccccgaucggcaagugcaacagcgagugcaucacgcccaacggguccauccccaacgacaagcccuuccagaacgugaaccggaucaccuacggcgccugcccgcgcuacgucaagcagaacacccugaagcucgccaccgggaugcggaacgugcccgagaagcagacgcgcggcaucuucggggccaucgccggcuucaucgagaacggcugggaggggaugguggacggcugguacggguuccggcaccagaacagcgagggccgcgggcaggccgccgaccugaaguccacccaggcggccaucgaccagaucaacggcaagcugaaccggcucaucggcaagaccaacgagaaguuccaccagaucgagaaggaguucagcgaggucgaggggcgcauccaggaccuggagaaguacguggaggacaccaagaucgaccugugguccuacaacgccgagcuccugguggcccuggagaaccagcacacgaucgaccucaccgacagcgagaugaacaagcuguucgagaagaccaagaagcagcugcgggagaacgccgaggacaugggcaacgggugcuucaagaucuaccacaagugcgacaacgcgugcaucggcuccauccgcaacgggaccuacgaccacgacgucuaccgcgacgaggcccucaacaaccgguuccagaucaagggcguggagcugaaguccggcuacaaggacuggauccuguggaucuccuucgccaucagcugcuuccuccugugcguggcccugcucggguucaucaugugggccugccagaagggcaacauccgcugcaacaucugcaucuga

SEQ ID NO: 64804 - RNA, 1701 nt, Artificial Sequence
  derived and/or modified sequence opt1 from hemagglutinin__InfluenzaA__ACZ81558
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccacugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucgagaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacaugggcaacgggugcuucaagaucuaccacaagugcgacaacgccugcaucggcuccauccgcaacgggaccuacgaccacgacguguaccgggacgaggcccucaacaaccgcuuccagaucaagggcgucgagcugaaguccggguacaaggacuggauccuguggaucuccuucgccaucagcugcuuccuccugugcguggcccugcucggcuucaucaugugggcgugccagaagggcaacauccggugcaacaucugcaucuga

SEQ ID NO: 64805 - RNA, 1701 nt, Artificial Sequence
  derived and/or modified sequence opt1 from hemagglutinin__InfluenzaA__ACZ81559
augaagaccaucaucgcccugagcuacauccucugccugguguucgcccagaagcugcccggcaacgacaacuccaccgcgacgcucugccuggggcaccacgccgucccgaacggcaccaucgugaagaccaucaccaacgaccagaucgaggugacgaacgccaccgagcugguccagagcuccagcaccggggagaucugcgacagcccccaccagauccucgacggcaagaacugcacccugaucgacgcccugcucggggacccccacugcgacggcuuccagaacaagaagugggaccuguucguggagcgcagcaaggccuacuccaacugcuaccccuacgacgugccggacuacgcgagccugcggucccucgucgccagcuccggcacgcuggaguucaacaacgagagcuucaacuggaccggggugacccagaacggcaccuccagcgccugcauccgccgguccaagaacagcuucuucucccgccugaacuggcucacgcaccugaacuucaaguaccccgcccugaacgugaccaugcccaacaacgagcaguucgacaagcucuacaucuggggcguccaccaccccgggaccgacaaggaccagaucuuccuguacgcgcaggccagcgggcggaucaccguguccacgaagcgcagccagcagaccgccaucccgaacaucggcagccggccccgcgugcggaacauccccucccgcaucagcaucuacuggaccaucgucaagcccggcgacauccugcucaucaacuccaccgggaaccugaucgccccgcggggcuacuucaagauccgcagcgggaaguccagcaucaugcgguccgacgcccccaucggcaagugcaacagcgagugcaucacgcccaacggcuccauccccaacgacaagccguuccagaacgugaaccgcaucaccuacggggcgugcccccgguacgugaagcagaacacccugaagcucgccaccggcaugcgcaacguccccgagaagcagacgcgggggaucuucggcgccaucgccggguucaucgagaacggcugggagggcaugguggacgggugguacggcuuccgccaccagaacagcgaggggcggggccaggccgcggaccugaaguccacccaggccgccaucgaccagaucaacgggaagcugaaccgccucaucggcaagaccaacgagaaguuccaccagaucgagaaggaguucagcgagguggagggccggauccaggaccuggagaaguacgucgaggacaccaagaucgaccugugguccuacaacgccgagcuccugguggcccuggagaaccagcacacgaucgaccucaccgacagcgagaugaacaagcuguucgagaagaccaagaagcagcugcgcgagaacgcggaggacauggggaacggcugcuucaagaucuaccacaagugcgacaacgccugcaucggguccauccgcaacggcaccuacgaccacgacguguaccgggacgaggcccucaacaaccgcuuccagaucaagggggucgagcugaaguccggcuacaaggacuggauccuguggaucuccuucgccaucagcugcuuccuccugugcguggcccugcucggcuucaucaugugggcgugccagaaggggaacauccggugcaacaucugcaucuga

SEQ ID NO: 64806 - RNA, 1701 nt, Artificial Sequence; identical to SEQ ID NO: 63677
  derived and/or modified sequence opt1 from hemagglutinin__InfluenzaA__ACZ81632

SEQ ID NO: 64807 - RNA, 1701 nt, Artificial Sequence; identical to SEQ ID NO: 63677
  derived and/or modified sequence opt1 from hemagglutinin__InfluenzaA__ACZ81642
